Figure 3:
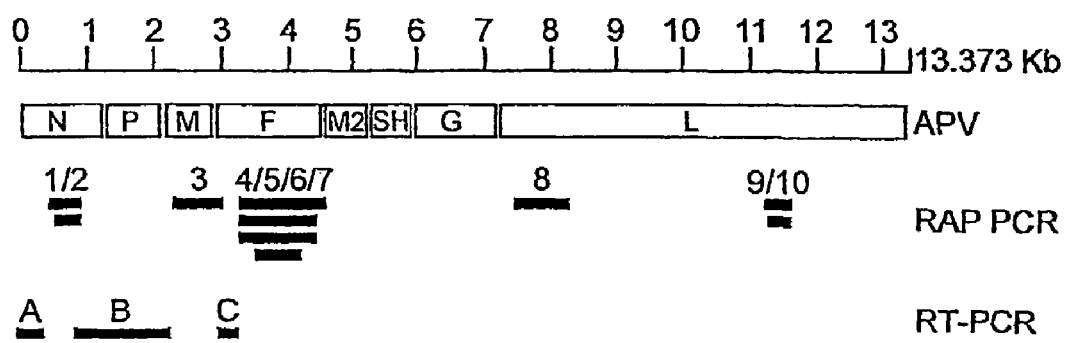

(12) United States Patent
Fouchier et al.

(10) Patent No.: US 7,449,324 B2
(45) Date of Patent: Nov. 11, 2008

(54) **METAPNEUMOVIRUS STRAINS AND THEIR USE IN VACCINE FORMULATIONS AND AS VECTORS FOR EXPRESSION OF ANTIGENIC

OTHER PUBLICATIONS

Ahmadian et al. Detection and characterization of proteins encoded by the second ORF of the M2 gene of pneumoviruses. J Gen Virol. Aug. 1999;80 ( Pt 8):2011-2016.

Bayon-Auboyer et al. Comparison of F-, G- and N-based RT-PCR protocols with conventional virological procedures for the detection and typing of turkey rhinotracheitis virus. Arch Virol. 1999;144(6):1091-1109.

Bayon-Auboyer et al. Nucleotide sequences of the F, L and G protein genes of two non-A/non-B avian pneumoviruses (APV) reveal a novel APV subgroup. J Gen Virol. Nov. 2000;81(Pt 11):2723-2733.

Beare et al. Trials in man with live recombinants made from A/PR/8/34 (H0 N1) and wild H3 N2 influenza viruses. Lancet. Oct. 18, 1975;2(7938):729-32.

Beeler et al. Neutralization epitopes of the F glycoprotein of respiratory syncytial virus: effect of mutation upon fusion function. J Virol. Jul. 1989;63(7):2941-50.

Bentley et al. Human immunoglobulin variable region genes—DNA sequences of two V kappa genes and a pseudogene. Nature. Dec. 25, 1980;288(5792):730-3.

Botts and Takashi et al. On the mechanism of energy transduction in myosin subfragment 1. Proc Natl Acad Sci U S A. Apr. 1984;81(7):2060-4.

Bridgen et al. Rescue of a segmented negative-strand RNA virus entirely from cloned complementary DNAs. Proc Natl Acad Sci U S A. Dec. 24, 1996;93(26):15400-4.

Buchholz et al. Generation of bovine respiratory syncytial virus (BRSV) from cDNA: BRSV NS2 is not essential for virus replication in tissue culture, and the human RSV leader region acts as a functional BRSV genome promoter. J Virol. Jan. 1999;73(1):251-9.

Buys et al. 1980, Turkey 28:36-46.

Cavanagh et al. Pneumovirus-like characteristics of the mRNA and proteins of turkey rhinotracheitis virus. Virus Res. Oct. 1988;11(3):241-56.

Collins et al. Characterization of a virus associated with turkey rhinotracheitis. J Gen Virol. Apr. 1988;69 ( Pt 4):909-16.

Collins et al. Production of infectious human respiratory syncytial virus from cloned cDNA confirms an essential role for the transcription elongation factor from the 5' proximal open reading frame of the M2 mRNA in gene expression and provides a capability for vaccine development. Proc Natl Acad Sci U S A. Dec. 5, 1995;92(25):11563-7.

Collins et al., 1993, Avian Pathology, 22:469-79.

Cook et al., Avian Pathol. 1988, 17:403-10.

Cook et al., 1993, Avian Pathology, 22:257-73.

Domachowske et al. Respiratory syncytial virus infection: immune response, immunopathogenesis, and treatment. Clin Microbiol Rev. Apr. 1999; 12(2):298-309. Review.

Durbin et al. Human parainfluenza virus type 3 (PIV3) expressing the hemagglutinin protein of measles virus provides a potential method for immunization against measles virus and PIV3 in early infancy. J Virol. Aug. 2000;74(15):6821-31.

Durbin et al. Recovery of infectious human parainfluenza virus type 3 from cDNA. Virology. Sep. 1, 1997;235(2):323-32.

Ennis et al. Recombination of influenza A virus strains: effect on pathogenicity. Dev Biol Stand. 1976;33:220-5.

Evans AS (ed.) Viral infections of Humans, Epidemiology and Control. 3rd edition, pp. 22-28, Plenum Publishing Corp. New York, 1989.

Falsey AR., Noninfluenza respiratory virus infection in long-term care facilities. Infect Control Hosp Epidemiol. Oct. 1991;12(10):602-8. Review.

Fields et al., eds, *Fields Virology*, 2nd ed., vol. 1, Raven Press, New York, 1990, pp. 1045-1072.

Flint et al., *Principles of virology, Molecular Biology, Pathogenesis and Control*. ASM Press 2000, pp. 25-56.

Florent et al. RNAs of influenza virus recombinants derived from parents of known virulence for man. Arch Virol. 1977;54(1-2):19-28.

Garvie et al. Outbreak of respiratory syncytial virus infection in the elderly. Br Med J. Nov. 8, 1980;281(6250):1253-4.

Giraud et al. Turkey rhinotracheitis in France: preliminary investigations on a ciliostatic virus. Vet Rec. Dec. 13, 1986;119(24):606-7.

Glezen et al. Risk of respiratory syncytial virus infection for infants from low-income families in relationship to age, sex, ethnic group, and maternal antibody level. J Pediatr. May 1981;98(5):708-15.

Groothuis et al. Respiratory syncytial virus infection in children with bronchopulmonary dysplasia. Pediatrics. Aug. 1988;82(2):199-203.

Groothuis et al. Prophylactic administration of respiratory syncytial virus immune globulin to high-risk infants and young children. The Respiratory Syncytial Virus Immune Globulin Study Group. N Engl J Med. Nov. 18, 1993;329(21):1524-30.

Hall et al. Neonatal respiratory syncytial virus infection. N Engl J Med. Feb. 22, 1979;300(8):393-6.

Hall, Contemp. Pediatr. 1993, 10:92-110.

Heckert et al. Absence of antibodies to avian pneumovirus in Canadian poultry. Vet Rec. Feb. 13, 1993;132(7):172.

Hemming et al. Studies of passive immunotherapy for infections of respiratory syncytial virus in the respiratory tract of a primate model. J Infect Dis. Nov. 1985;152(5):1083-7.

Henderson et al. Respiratory-syncytial-virus infections, reinfections and immunity. A prospective, longitudinal study in young children. N Engl J Med. Mar. 8, 1979;300(10):530-4.

Hertz et al. Respiratory syncytial virus-induced acute lung injury in adult patients with bone marrow transplants: a clinical approach and review of the literature. Medicine (Baltimore). Sep. 1989;68(5):269-81. Review.

Hoffmann et al. A DNA transfection system for generation of influenza A virus from eight plasmids. Proc Natl Acad Sci U S A. May 23, 2000;97(11):6108-13.

Huygelen et al. Laboratory and clinical evaluation of new live influenza virus vaccines. Need for minimum requirements. Dev Biol Stand. Jun. 1-3, 1977;39:155-60.

Inoue et al. An improved method for recovering rabies virus from cloned cDNA. J Virol Methods. Feb. 2003;107(2):229-36.

Ishiguro et al., 2004, "High genetic diversity of the attachment (G) protein of human metapneumovirus," J. Clin. Microbiol. 42(8):3406-3414.

Johnson et al. The G glycoprotein of human respiratory syncytial viruses of subgroups A and B: extensive sequence divergence between antigenically related proteins. Proc Natl Acad Sci U S A. Aug. 1987;84(16):5625-9.

Juhasz et al. Extensive sequence variation in the attachment (G) protein gene of avian pneumovirus: evidence for two distinct subgroups. J Gen Virol. Nov. 1994;75 ( Pt 11):2873-80.
Kapikian et al. An epidemiologic study of altered clinical reactivity to respiratory syncytial (RS) virus infection in children previously vaccinated with an inactivated RS virus vaccine. Am J Epidemiol. Apr. 1969;89(4):405-21.
Kim et al. Respiratory syncytial virus disease in infants despite prior administration of antigenic inactivated vaccine. Am J Epidemiol. Apr. 1969;89(4):422-34.
Krempl et al. Recombinant respiratory syncytial virus with the G and F genes shifted to the promoter-proximal positions, J Virol. Dec. 2002;76(23):11931-42.
Krystal et al. Expression of the three influenza virus polymerase proteins in a single cell allows growth complementation of viral mutants. Proc Natl Acad Sci U S A. Apr. 1986;83(8):2709-13.
Lamprecht et al. Role of maternal antibody in pneumonia and bronchiolitis due to respiratory syncytial virus. J Infect Dis. Sep. 1976;134(3):211-7.
Ling et al. Sequence analysis of the 22K, SH and G genes of turkey rhinotracheitis virus and their intergenic regions reveals a gene order different from that of other pneumoviruses. J Gen Virol. Jul. 1992;73 (Pt 7):1709-15.
Lopez et al. Antigenic structure of human respiratory syncytial virus fusion glycoprotein. J Virol. Aug. 1998;72(8):6922-8.
MacDonald et al. Respiratory syncytial viral infection in infants with congenital heart disease. N Engl J Med. Aug. 12, 1982;307(7):397-400.
Marriott AC, Easton AJ. Reverse genetics of the Paramyxoviridae. Adv Virus Res. 1999;53:321-40.
Marriott et al. Fidelity of leader and trailer sequence usage by the respiratory syncytial virus and avian pneumovirus replication complexes. J Virol. Jul. 2001;75(14):6265-72.

Morell et al., eds., *Clinical Use of Intravenous Immunoglobulins*. Academic Press, London 1986, pp. 285-294.

Murphy et al. An update on approaches to the development of respiratory syncytial virus (RSV) and parainfluenza virus type 3 (PIV3) vaccines. Virus Res. Apr. 1994;32(1):13-36. Review.

Murphy et al. Passive transfer of respiratory syncytial virus (RSV) antiserum suppresses the immune response to the RSV fusion (F) and large (G) glycoproteins expressed by recombinant vaccinia viruses. J Virol. Oct. 1988;62(10):3907-10.

Murphy et al. Effect of passive antibody on the immune response of cotton rats to purified F and G glycoproteins of respiratory syncytial virus (RSV). Vaccine. Mar. 1991;9(3):185-9.

Navas et al. Improved outcome of respiratory syncytial virus infection in a high-risk hospitalized population of Canadian children. Pediatric Investigators Collaborative Network on Infections in Canada. J Pediatr. Sep. 1992;121(3):348-54.

Naylor et al. The ectodomains but not the transmembrane domains of the fusion proteins of subtypes A and B avian pneumovirus are conserved to a similar extent as those of human respiratory syncytial virus. J Gen Virol. Jun. 1998;79(Pt 6):1393-8.

Neumann et al. Reverse genetics demonstrates that proteolytic processing of the Ebola virus glycoprotein is not essential for replication in cell culture. J Virol. Jan. 2002;76(1):406-10.

Nissen et al., 2002, "Evidence of human metapneumovirus in Australian children," Med. J. Australia 176(4):188.

O'Brien JD. Swollen head syndrome in broiler breeders. Vet Rec. Dec. 7, 1985;117(23):619-20.

Ogra et al. Respiratory syncytial virus infection and the immunocompromised host. Pediatr Infect Dis J. Apr. 1988;7(4):246-9.

Palese et al. Negative-strand RNA viruses: genetic engineering and applications. Proc Natl Acad Sci U S A. Oct. 15, 1996;93(21):11354-8. Review.

Peeters et al. Rescue of Newcastle disease virus from cloned cDNA: evidence that cleavability of the fusion protein is a major determinant for virulence. J Virol. Jun. 1999;73(6):5001-9.

Peret et al. Characterization of human metapneumoviruses isolated from patients in North America. J Infect Dis. Jun. 1, 2002;185(11):1660-3. Epub May 3, 2002.

Poch et al. Sequence comparison of five polymerases (L proteins) of unsegmented negative-strand RNA viruses: theoretical assignment of functional domains. J Gen Virol. May 1990;71 ( Pt 5):1153-62.

Poch et al., Identification of four conserved motifs among the RNA-dependent polymerase encoding elements. EMBO J. Dec. 1, 1989;8(12):3867-74.

Pohl et al. Respiratory syncytial virus infections in pediatric liver transplant recipients. J Infect Dis. Jan. 1992;165(1):166-9.

Press et al. The amino acid sequences of the Fd fragments of two human gamma-1 heavy chains. Biochem J. May 1970;117(4):641-60.

Prince et al. Immunoprophylaxis and immunotherapy of respiratory syncytial virus infection in the cotton rat. Virus Res. Oct. 1985;3(3):193-206.

Prince et al. Mechanism of antibody-mediated viral clearance in immunotherapy of respiratory syncytial virus infection of cotton rats. J Virol. Jun. 1990;64(6):3091-2.

Prince et al. Mechanisms of immunity to respiratory syncytial virus in cotton rats. Infect Immun. Oct. 1983;42(1):81-7.

Prince et al. Quantitative aspects of passive immunity to respiratory syncytial virus infection in infant cotton rats. J Virol. Sep. 1985;55(3):517-20.

Prince, GA, Ph.D. diss., University of California, LA 1975.

Pringle CR. Virus taxonomy—San Diego 1998. Arch Virol. 1998;143(7):1449-59.

Pringle et al. Virus taxonomy at the XIth International Congress of Virology, Sydney, Australia, 1999. Arch Virol. 1999;144(10):2065-70.

Randhawa et al. Rescue of synthetic minireplicons establishes the absence of the NS1 and NS2 genes from avian pneumovirus. J Virol. Dec. 1997;71(12):9849-54.

Ruuskanen et al. Respiratory syncytial virus. Curr Probl Pediatr. Feb. 1993;23(2):50-79. Review.

Schnell et al. Infectious rabies viruses from cloned cDNA. EMBO J. Sep. 15, 1994;13(18):4195-203.

Seal BS. Matrix protein gene nucleotide and predicted amino acid sequence demonstrate that the first US avian pneumovirus isolate is distinct from European strains. Virus Res. Nov. 1998;58(1-2):45-52.

Senne et al., 1998, In: Proc. 47th WPDC, CA, pp. 67-68.

Skiadopoulos et al. Three amino acid substitutions in the L protein of the human parainfluenza virus type 3 cp45 live attenuated vaccine candidate contribute to its temperature-sensitive and attenuation phenotypes. J Virol. Mar. 1998;72(3):1762-8.

Sullender et al. Respiratory syncytial virus genetic and antigenic diversity. Clin Microbiol Rev. Jan. 2000;13(1):1-15, table of contents. Review.

Takashi et al. Angiomyolipoma of the kidney: report of three cases and a statistical study of 194 cases in Japan Hinyokika Kiyo. Jan. 1984;30(1):65-75.

Tao et al. A live attenuated chimeric recombinant parainfluenza virus (PIV) encoding the internal proteins of PIV type 3 and the surface glycoproteins of PIV type 1 induces complete resistance to PIV1 challenge and partial resistance to PIV3 challenge. Vaccine. Mar. 5, 1999;17(9-10):1100-8.

Tao et al. Recovery of a fully viable chimeric human parainfluenza virus (PIV) type 3 in which the hemagglutinin-neuraminidase and fusion glycoproteins have been replaced by those of PIV type 1. J Virol. Apr. 1998;72(4):2955-61.

Teng et al. Recombinant respiratory syncytial virus that does not express the NS1 or M2-2 protein is highly attenuated and immunogenic in chimpanzees. J Virol. Oct. 2000;74(19):9317-21.

van den Hoogen et al. A newly discovered human pneumovirus isolated from young children with respiratory tract disease. Nat Med. Jun. 2001; 7(6):719-24.

van den Hoogen et al. Analysis of the genomic sequence of a human metapneumovirus. Virology. Mar. 30, 2002;295(1):119-32.

Volchkov et al. Recovery of infectious Ebola virus from complementary DNA: RNA editing of the GP gene and viral cytotoxicity. Science. Mar. 9, 2001;291(5510):1965-9.

Yu et al. Cloning and sequencing of the matrix protein (M) gene of turkey rhinotracheitis virus reveal a gene order different from that of respiratory syncytial virus. Virology. Feb. 1992;186(2):426-34.

Yu et al. Sequence and in vitro expression of the M2 gene of turkey rhinotracheitis pneumovirus. J Gen Virol. Jun. 1992;73 ( Pt 6):1355-63.

Yu et al., 1991, "Deduced amino acid sequence of the fusion glycoprotein of turkey rhinotracheitis virus has a greater identity with that of human respiratory syncytial virus, a pneumovirus, than that of paramyxoviruses and morbilliviruses," J. Gen. Virol. 72:75-81.

Database EBI 'Online! SWALL; Dec. 1, 2001 "Nucleoprotein" Database accession No. Q91F57.

Database EBI 'Online! SWALL; May 1, 2000 "Nucleocapsid protein" Database accession No. Q9QF48.

Database EBI 'Online! SWALL; Dec. 1, 2001 "Phosphoprotein," Database accession No. Q91KZ5.

Database EBI 'Online! SWALL; May 1, 2000 "Phosphoprotein," Database accession No. Q9QF47.

Database EBI 'Online! SWALL; Dec. 1, 2001 "Matrix protein," Database accession No. Q91F56.

Database EBI 'Online! SWALL; Nov. 1, 1998 "Matrix protein," Database accession No. O90244.

Database EBI 'Online! SWALL; Dec. 1, 2001 "Fusion protein," Database accession No. Q91F55.

Database EBI 'Online! SWALL; May 1, 2000 "Fusion protein," Database accession No. Q9QDI1.

Database EBI 'Online! SWALL; Dec. 1, 2001 "RNA-dependent RNA polymerase," Database accession No. Q91L20.

Database EBI 'Online! SWALL; May 1, 1997 "RNA-dependent RNA polymerase," Database accession No. P87509.

Williams et al., 2006, "The role of human metapneumovirus in upper respiratory tract infections in children: a 20-year experience," J Infect Dis. 193(3):387-95.

Nissen et al., 2002, "Evidence of human metapneumovirus in Australian children," Med J Aust. Feb. 18, 2002;176(4):188.

Bastien et al., 2003, "Sequence analysis of the N, P, M and F genes of Canadian human metapneumovirus strains," Virus Res. 93(1):51-62.

Greensill et al., 2003, "Human metapneumovirus in severe respiratory syncytial virus bronchiolitis," Emerg. Infect. Dis. 9(3):372-5.

Schmidt et al., 2001, "Recombinant bovine/human parainfluenza virus type 3 (B/HPIV3) expressing the respiratory syncytial virus (RSV) G and F proteins can be used to achieve simultaneous mucosal immunization against RSV and HPIV3," J. Virol. 75(10):4594-603.

Tang et al., 2003, "Effects of human metapneumovirus and respiratory syncytial virus antigen insertion in two 3' proximal genome positions of bovine/human parainfluenza virus type 3 on virus replication and immunogenicity," J. Virol. 77(20):10819-29.

Database EMBL Online, 2001, Database Accession No. AF371337, Jun. 18, 2002.
Database EMBL Online, 2002, Database Accession No. AY145294, Nov. 1, 2002.
Bailly et al., 2000, "Recombinant human parainfluenza virus type 3 (PIV3) in which the nucleocapsid N protein has been replaced by that of bovine PIV3 is attenuated in primates," J. Virol. 74(7):3188-95.
Barr, 1991, "Mammalian subtilisins: the long-sought dibasic processing endoproteases," Cell 66: 1-3.
Bastein et al., 2003, "Human metapneumovirus infection in the Canadian population," J. Clin. Microbiol. 41: 4642-4646.
Biacchesi et al., 2003, "Genetic diversity between human metapneumovirus subgroups," Virology 315: 1-9.
Boivin et al., 2002, "Virological features and clinical manifestations associated with human metapneumovirus: anew paramyxovirus responsible for acute respiratory-tract infections in all age groups," J. Infect. Dis. 186: 1330-1334.
Boivin et al., 2003, "Human metapneumovirus infections in hospitalized children," Emerg. Infect. Dis. 9: 634-640.
Bosch et al., 1981, "Proteolytic cleavage of influenza virus hemagglutinin. Primary structure of the connecting peptide between HA1 and HA2 determines proteolytic cleavability and pathogenicity of avian influenza viruses," Virology 113: 725-735.
Breker-Klassen et al. 1996, "Comparisons of the F and HN gene sequences of different strains of bovine parainfluenza virus type 3: relationship to phenotype and pathogenicity," Can J Vet Res. 60(3):228-236.
Chanock et al. 1989, "Respiratory Syncytial Virus" Chapter 20 IN Evans, edu., 1989, *Viral Infections of Humans: Epidemiology and Control*, 3rd ed., Plenum Medical Book, New York, pp. 525-544.
Clements et al. 1991, "Evaluation of bovine, cold-adapted human, and wild-type human parainfluenza type 3 viruses in adult volunteers and in chimpanzees," J Clin Microbiol. 29(6):1175-1182.
Collins et al., 1991, "Post translational processing and oligomerization of the fusion gylcoproteinof human respiratory syncytial virus," J. Gen. Virol. 72: 3095-3101.
Collins et al., 1993, "Deduced amino acid sequences at the fusion protein cleavage site of Newcastle disease viruses showing variation in antigenicity and pathogenicity," Arch. Virol. 128: 363-370.
Collins et al., 1996, Fields Virology, ed. V.N. Knipe, Howley, P.M., Philadelphia: Lippencott-Raven. pp. 1313-1351.
Collins et al., 2001 (Eds.), Fields Virology, fourth ed. Lippincott Williams and Wilkins, Philadelphia, PA, pp. 1443-1485.
Collins, 1990, "The Molecular Biology of Human Respiratory Syncytial Virus ()RSV) of the Genus Pneumovirus", The Paramyxoviruses, D.W. Kingsbury, ed. Plenum Press, New York, pp. 103-162.
Cook et al., 1999, "Preliminary antigenic characterization of an avian pneumovirus isolated from Turkeys in Colorado, USA," Avian Pathol. 28:607-617.
Cook JK, 2000, "Avian rhinotracheitis," Rev. Sci. Tech. 19(2):602-613.
Crookshanks et al., 1984, "Evaluation of cold-adapted and temperature-sensitive mutants of parainfluenza virus type 3 in weanling hamsters," J. Med Virol. 13(3):243-249.
Dimcock et al., 1993, "Rescue of synthetic analogs of genomic RNA and replicative-intermediate RNA of human parainfluenza virus type 3," J Virol. 67(5):2772-8.
Feigen et al. eds., 1987, Textbook of Pediatric Infectious Diseases, WB Saunders, Philadelphia, pp. 1653-1675.
Glickman et al., 1988, "Quantitative basic residue requirements in the cleavage-activation site of the fusion glycoprotein as a determinant of virulence for Newcastle disease virus," J. Virol. 62:354-356.
Gonzalez-Reyes et al., 2001, "Cleavage of the human respiratory syncytial virus fusion protein at two distinct sites is required for activation of membrane fusion," PNAS 98, pp. 9859-9864.
Haller et al. 2000, "Expression of the surface glycoproteins of human parainfluenza virus type 3 by bovine parainfluenza virus type 3, a novel attenuated virus vaccine vector," J Virol. 74(24):11626-11635.
Hamelin et al., 2004, "Human metapneumovirus: anew player among respiratory viruses," Clinical Infectious Diseases 38: 983-990.
Herfst, 2004, "Recovery of human metapneumovirus genetic lineages A and B from cloned cDNA," J. Virol. 78:8264-8270.
Howe., 2002, "Australian find suggests worldwide reach for metapneumovirus,"Lancet Infect. Dis. 2:202.
Ijpma et al., 2004, "Human metapneumovirus infection in hospital referred South African children," J. Med. Virol. 73:486-493.
Ishida et al., 1978, "Sendai virus," Adv. Virus Res. 23:349-383.
Johnson et al. 1997, "Development of a humanized monoclonal antibody (MEDI-493) with potent in vitro and in vivo activity against respiratory syncytial virus," J Infect Dis. 176(5):1215-1224.
Karron et al. 1995, "A live attenuated bovine parainfluenza virus type 3 vaccine is safe, infectious, immunogenic, and phenotypically stable in infants and children," J Infect Dis. 171(5):1107-1114.
Karron et al. 1996, "Evaluation of a live attenuated bovine parainfluenza type 3 vaccine in two- to six-months-old infants," Pediatr Infect Dis J. 15(8):650-654.
Kawaoka et al., 1984, "I virulence of H5N2 influenza viruses in chickens associated with loss of carbohydrate from the hemagglutinin?" Virology 139: 303-316.
Kido et al., 1992, "Isolation and characterization of a novel trypisn-like protease found in rat bronchiolar epithelial Clara cells: a possible activator of the viral fusion glycoprotein," J. Biol. Chem. 267: 13573-13579.
Kido et al., 1996, "Cellular proteases involved in the pathogenicity of enveloped animal viruses, human immunodeficiency virus, influenza virus A and Sendai virus," Adv. Enzyme Regul. 36: 325-47.
Klenk et al., 1988, "The molecular biology of influenza virus pathogenicity," Adv. Virus Res. 34: 247-281.
Klenk et al., 1994, "Host cell proteases controlling vius pathogenicity," Trends Microbiol. 2 (2): 39-43.
Klippmark et al. 1990, "Antigenic variation of human and bovine parainfluenza virus type 3 strains," J Gen Virol. 71 ( Pt 7):1577-80.
Kunkel et al. 1985, "Rapid and efficient site-specific mutagenesis without phenotypic selection," Proc natl Acad Sci U S A. 82(2):488-492.
Lamb, 1993, "Paramyxovirus fusion: A hypothesis for changes," Virology 197: 1-11.
Maggi et al., 2003, "Human metapneumovirus associated with respiratory tract infections in a 3-year study of nasal swabs from infants in Italy," J. Clinical Microbiology 41: 2987-2991.
Morrison, 2003, "Structure and function of a paramyxovirus fusion protein," Biochimica Et Biophysica Acta 1614: 73-84.
Nagai et al., 1989, "Molecular biology of Newcastle disease virus," Prog. Vet. Microbiol. 5: 16-64.
New Vaccine Development, Establishing Priorities, vol. 1, 1985, National Academy Press, Washington DC pp. 397-409.
Oomens et al., 2003, "Recovery of infectious human respiratory syncytial virus lacking all transmembrane glycoprotein genes via trans-complementation," 12th Int'l. Conf. on Negative Strand Viruses, Pisa, Italy, Abstr #205.
Peiris et al., 2003, "Children with respiratory disease associated with metapneumovirus in Hong Kong," Emerg. Infect. Dis. 9: 628-633.
Peret et al., 2004, "Sequence polymorphism of the predicted human metapneumovirus G glycoprotein," J. Infect. Dis. 85: 679-686.
Randhawa et al., 1996 "Nucleotide sequence of the gene encoding the viral polymerase of avian pneumovirus." J. Gen. Virol. 77: 3047-3051.
Russell et al., 2001, "Membrane fusion machines of paramyxoviruses: capture of intermediates of fusion," EMBO J. 20: 4024-4034.
Scheid et al., 1974, "Identification of the biological activities of paramyxovirus glycoproteins. Activation of cell fusion, hemolysis and infectivity by proteolytic of an inactive precursor protein of Sendaivirus," Virology 57:475-490.

Scheid et al., 1977, "Two disulfide linked polypeptide chains constitute the active F protein of paramyxoviruses," Virology 80: 54-66.

Schickli et al., 2005, "An S101P substitution in the putative cleavage motif of the human metapneumovirus fusion protein is a major determinant for trypsin-independent growth in Vero cells and does not alter tissue tropism in hamsters," J. Virol. 79(16):10678-89.

Schmidt et al. 2000, "Bovine parainfluenza virus type 3 (BPIV3) fusion and hemagglutinin-neuraminidase glycoproteins make an important contribution tothe restricted replication of BPIV3 in primates," J Virol. 74(19):8922-8929.

Schmidt et al., 2002, "Mucosal immunization of Rhesus monkeys against respiratory syncytial virus subgroups A and B human parainfluenza virus type 3 by using a live cDNA-derived vaccine based on a host range-attenuated bovine parainfluenza virus type 3 vector backbone," J. Virol. 76 :1089-1099.
Seal BS. 2000, "Avian pneumoviruses and emergence of a new type in the United States of America," Anim Health Res Rev. 1(1):67-72.
Seal et al., 2000, "Fusion protein predicted amino acid sequence of the first US avian pneumovirus isolate and lack of heterogeneity among other US isolates," Virus. Res. 66: 139-147.
Shibuta, 1977, "Characterization of bovine parainfluenza virus type 3," Microbiol. Immunol. 23(7)617-628.
Skiadopoulos et al., 2001, "A chimeric human-bovine parainfluenza virus type 3 expressing measles virus hemagglutinin is attenuated for replication but is still immunogenic in rhesus monkeys," J. Virol. 75(21):10498-504.
Skiadopoulos, 2004, "The two major human metapneumovirus genetic lineages are highly related antigenically, and the fusion (F) protein is a major contributor to this antigenic relatedness," J. Virol. 78:6927-6937.
Stockton et al., 2002, "Human metapneumovirus as a cause of community-acquired respiratory illness," Emerg. Infect. Dis. 8, 897-901.
Takashi et al., 1984, "On the mechanism of energy transduction in myosin subfragment 1," PNAS USA vol. 81:2060-2064.
Tao et al., 2000, "Replacement of the ectodomains of the hemagglutinin-neuraminidase and fusion glycoproteins of recombinant parainfluenza virus type 3 (PIV3) with their counterparts from PIV2 yields attenuated PIV2 vaccine candidates," J. Virol. 74(14):6448-58.
Tashiro et al., 1983, "Pneumotropism o Sendai virus in relation to protease-mediated activation in mouse lungs," Infect. Immun. 39: 879-888.
Tashiro et al., 1988, "Characterization of a pantropic variant of Sendai virus derived from a host-range mutant," Virology 165:577-583.
Toquin et al., 2003, "Subgroup C avian metapneumovirus (MPV) and the recently isolated human MPV exhibit a common organization but have extensive sequence divergence in their putative SH and G genes," J. of General Virology. 84: 2169-2178.
Towatari et al., 2002, "Identification of ectopic anionic trypsin I in rat lungs potentiating pneumotropic virus infectivity and increased enzyme level after virus infection," Eur. J. Biochem. 269: 2613-2621.
Toyoda et al., 1987, "Structural comparison of the cleavage-activation site of the fusion glycoprotein between virulent and avirulent strains of Newcastle disease virus," Virology 158: 242-247.
Van Den Hoogen et al., 2003, "Prevalence and clinical symptoms of human metapneumovirus infection in hospitalized patients," J. Infect. Dis. 188: 1571-1577.
Van Den Hoogen et al., 2004, "Clinical impact and diagnosis of hMPV infections," Pediatric Infectious Disease Journal, 23: S25-32.
Van Den Hoogen et al., 2004, "Antigenic and genetic variability of human metapneumovirus," Emerging Infectious Diseases 10: 658-666.
Van Wyke Coelingh et al. 1990, "Antibody responses of humans and nonhuman primates to individual antgenic sites of the hemagglutinin-neuraminidase and fusion glycoproteins after primary infection or reinfection with parainfluenza type 3 virus," J Virol. 64(8):3833-3843.
Wang et al., 2003,"Both heptad repeats of human respiratory syncytial virus fusion protein are potent inhibitors of viral fusion," Biochem. Biophys. Res. Commun. 302(3):469-75.
White, 1990, "Viral and cellular membrane fusion proteins," Annual Review Physiology 52: 675-697.
Williams et al., 2004, "Human metapneumovirus and lower respiratory tract disease in otherwise healthy infants and children," N. Engl. J. Med. 350: 443-450.
Wolf et al., D., 2003, "High seroprevalence of human metapneumovirus among young children in Israel," J. Inf. Dis. 188: 1865-1867.
OFFICE Action dated Jun. 28, 2004 of U.S. Appl. No. 10/371,264.
OFFICE Action dated Sep. 13, 2004 of U.S. Appl. No. 10/371,264.
OFFICE Action dated Nov. 24, 2004 of U.S. Appl. No. 10/371,264.
OFFICE Action dated May. 4, 2005 of U.S. Appl. No. 10/371,264.
OFFICE Action dated Jan. 24, 2006 of U.S. Appl. No. 10/371,264.
OFFICE Action dated Mar. 22, 2006 of U.S. Appl. No. 10/371,122.
OFFICE Action dated Mar. 22, 2006 of U.S. Appl. No. 10/373,567.
OFFICE Action dated Aug. 23, 2006 of U.S. Appl. No. 10/371,567.
OFFICE Action dated Aug. 25, 2006 of U.S. Appl. No. 10/371,122.
OFFICE Action dated Sep. 8, 2006 of U.S. Appl. No. 10/371,264.
OFFICE Action dated Oct. 5, 2006 of U.S. Appl. No. 10/722,045.
OFFICE Action dated Jan. 11, 2007 of U.S. Appl. No. 10/831,781.
OFFICE Action dated Mar. 1, 2007 of U.S. Appl. No. 10/371,122.
OFFICE Action dated Apr. 5, 2007 of U.S. Appl. No. 10/466,811.
OFFICE Action dated May. 11, 2007 of U.S. Appl. No. 10/373,567.
OFFICE Action dated Jun. 13, 2007 of U.S. Appl. No. 10/371,264.
OFFICE Action dated Jun. 13, 2007 of U.S. Appl. No. 10/831,781.
OFFICE Action dated Aug. 22, 2007 of U.S. Appl. No. 10/722,045.
OFFICE Action dated Jan. 11, 2007 of U.S. Appl. No. 10/371,122.
OFFICE Action dated Dec. 31, 2007 of U.S. Appl. No. 10/722,045.

* cited by examiner

M

| | 00-1 | hRSV | bRSV | PMV | APV-A | APV-C | APV-B |
|---|---|---|---|---|---|---|---|
| 00-1 | 1,00 | 0,37 | 0,37 | 0,37 | 0,77 | 0,87 | 0,75 |
| hRSV | --- | 1,00 | 0,91 | 0,41 | 0,37 | 0,37 | 0,37 |
| bRSV | --- | --- | 1,00 | 0,42 | 0,35 | 0,36 | 0,35 |
| PMV | --- | --- | --- | 1,00 | 0,37 | 0,38 | 0,38 |
| APV-A | --- | --- | --- | --- | 1,00 | 0,78 | 0,89 |
| APV-C | --- | --- | --- | --- | --- | 1,00 | 0,77 |
| APV-B | --- | --- | --- | --- | --- | --- | 1,00 |

N

| | 00-1 | hRSV | bRSV | PVM | APV-A | APV-C | APV-B |
|---|---|---|---|---|---|---|---|
| 00-1 | 1,00 | 0,20 | 0,22 | 0,21 | 0,40 | 0,52 | 0,40 |
| hRSV | --- | 1,00 | 0,59 | 0,30 | 0,18 | 0,21 | 0,18 |
| bRSV | --- | --- | 1,00 | 0,31 | 0,21 | 0,23 | 0,21 |
| PVM | --- | --- | --- | 1,00 | 0,21 | 0,23 | 0,21 |
| APVA | --- | --- | --- | --- | 1,00 | 0,42 | 1,00 |
| APVC | --- | --- | --- | --- | --- | 1,00 | 0,42 |
| APVB | --- | --- | --- | --- | --- | --- | 1,00 |

F

| | 00-1 | hRSV | bRSV | PVM | APV-A | APV-C | APV-B |
|---|---|---|---|---|---|---|---|
| 00-1 | 1,00 | 0,32 | 0,33 | 0,37 | 0,67 | 0,80 | 0,66 |
| hRSV | --- | 1,00 | 0,82 | 0,40 | 0,35 | 0,35 | 0,35 |
| bRSV | --- | --- | 1,00 | 0,41 | 0,34 | 0,36 | 0,34 |
| PVM | --- | --- | --- | 1,00 | 0,38 | 0,38 | 0,39 |
| APV-A | --- | --- | --- | --- | 1,00 | 0,72 | 0,84 |
| APV-C | --- | --- | --- | --- | --- | 1,00 | 0,72 |
| APV-B | --- | --- | --- | --- | --- | --- | 1,00 |

P

| | 00-1 | hRSV | bRSV | PMV | APV-A | APV-C |
|---|---|---|---|---|---|---|
| 00-1 | 1,00 | 0,25 | 0,26 | 0,27 | 0,55 | 0,67 |
| hRSV | --- | 1,00 | 0,81 | 0,30 | 0,28 | 0,26 |
| bRSV | --- | --- | 1,00 | 0,29 | 0,28 | 0,26 |
| PMV | --- | --- | --- | 1,00 | 0,23 | 0,27 |
| APV-A | --- | --- | --- | --- | 1,00 | 0,52 |
| APV-C | --- | --- | --- | --- | --- | 1,00 |

L8

| | 00-1 | hRSV | bRSV | APV-A |
|---|---|---|---|---|
| 00-1 | 1,00 | 0,36 | 0,35 | 0,56 |
| hRSV | --- | 1,00 | 0,79 | 0,36 |
| bRSV | --- | --- | 1,00 | 0,35 |
| APV-A | --- | --- | --- | 1,00 |

L9/10

| | 00-1 | hRSV | bRSV | APV-A |
|---|---|---|---|---|
| 00-1 | 1,00 | 0,30 | 0,30 | 0,53 |
| hRSV | --- | 1,00 | 0,83 | 0,34 |
| bRSV | --- | --- | 1,00 | 0,32 |
| APV-A | --- | --- | --- | 1,00 |

FIGURE 1

Seroprevalence of hMPV in humans categorised by age group using immunofluorescence and virus neutralisation assays

| Age (Years) | Immunofluorescence assays | | Virus neutralisation assays | | |
| --- | --- | --- | --- | --- | --- |
|  | N tested | N positive | N tested | N positive | Titre range |
| <1 | 20 | 5 | 12 | 3 | 16-32 |
| 1-2 | 20 | 11 | 13 | 4 | 16-32 |
| 2-5 | 20 | 14 | 8 | 3 | 16-512 |
| 5-10 | 20 | 20 | 4 | 4 | 32-256 |
| 10-20 | 20 | 20 | 4 | 3 | 32-128 |
| >20 | 20 | 20 | 4 | 3 | 32-128 |
| 8-99[1] | 72 | 72 | 11 | 11 | 16-128 |

[1]Sero-archeological analysis using sera collected in 1958

FIGURE 2

Nucleo protein

```
00-1 NP  MSLQGIHLSDLSYKHAILKESQYTIKRDVGTTTAVTPSSLQQEITLLCGEILYAKHADYKYAAEIGIQYISTAIGSERVQQILRNSGSEVQVVLTRTYSL  10
APV A    ...ES.R....E......ED.....R....A...I...E..PQVST...MV.F...T..EP....V.M........AD.T....K.......G.M.KIVT.  10
APV B    ......Q............................R.VS...........T..SH...V.M..V..T..A..T....K........A...K....  10
APV C    ......Q............................R.VS...........T..SH...V.M..V..T..A..T....K........A...K....  10
bRSV     .A.SKVK.N.TFN.DQL.ST.K....Q.ST.DNIDIPNYDV.KHLNK...ML.ITED.NH.FTGL..ML.AMSR..R.DTLK..KDA.YQ.RANGVDVITH  10
hRSV     .A.SKVK.N.TLN.DQL.SS.K....Q.ST.DNIDTPNYDV.KHLNK...ML.ITED.NH.FTGL..ML.AMSR..R.DTIK..KDA.YH.KANGVDITTY  10
PVM      ...DRLK.N.V.N.DSL.SNCK.SVT.ST.DV.S.SGHAM.KALARTL.HF.LTAFNRCEEV....L..AMSL..RDDSIK...EA.YN.KC.D.QLKDF  10

00-1 NP  GKIKNNKGEDLQMLDIHGVEKSWVEEIDKEARKTMATLLKESSGNIPQNQRPSAPDTPIILLCVGALIFTKLASTIEVGLETTVRRANRVLSDALKRYPR  20
APV A    SAEGSVRKREV---N...D.GVG.ADDVERTT.EA..GAMVR.KV--QLTK...K....L.A.V....I............V......AI...S....IS....  19
APV B    ..G..S...E.........R...I..V........SAT.DN..P........S..A.....I...................A........N.....F..  20
APV C    ..G..S...E.........R...I..V........SAT.DN..P........S..A.....I...................A........N.....F..  20
bRSV     RQDV.G.EMKFEV.TLVSLTSEVQGN.EI.S...SYKKM...M-.EVAPEY.HDS...CGM.V...A..VI....AGDRS..TAVI....N..RNEM...KG  19
hRSV     RQDI.G.EMKFEV.TLSSLTSEIQVN.EI.S...SYKKM...M-.EVAPEY.HDS...CGM.I...IA..VI....AGDRS..TAVI....N..KNEI...KG  19
PVM      TIKLQG.EYKI.V...V.IDAANLADLEIQ...GVV.KE...TG-ARL.D.R.HD...CGV.V...IA...VVS...AGDRG..DAVE...LN..KAEKA...N  19

00-1 NP  MDIPKIARSFYDLFEQKVYHRSLFTEYGKALGSSSTGSKAESLFVNIFMQAYGAGQTMLRWGVIARSSNNIMLGHVSVQAELKQVTEVYDLVREMGPESG  30
APV A    ....R..K..FE...K....Y.N............T....RM......................................R..S.......K......  29
APV B    I...........Y................................................................................  30
APV C    I...........Y................................................................................  30
bRSV     LIPKD..N....EV..KYPHYIDV.VHF.I.QS.TRG...RV.GI.AGL..N......V......L.K.VK......A.....ME..V...EYAQKL.G.A.  29
hRSV     LIPKD..N....EV..KHPHLIDV.VHF.I.QS.TRG...RV.GI.AGL..N....S..V......L.K.VK......A.....ME..V...EYAQKL.G.A.  29
PVM      .EVKQ..E........R.P.YIDV..TF.L.QS.VRG...V.G..SGL..N......V.....LL.K.VK......A.....ME..V...EYAQKQ.G.A.  29

00-1 NP  LLHLRQSPKAGLLSIANCPNFASVVLGNASGLGIIGMYRGRVPNTELFSAAESYAKSLKESNKINFSSLGLTDEEKEAAEHFLNVSDDSQNDYE  39
APV A    ............T.............A.........K..A..L....A......RT.R.N....LAA.....D.R...TSY.GGD.ERSSKF.  39
APV B    ......N..........................L............A......R................E......N...INEEG.....  39
APV C    ......N..........................L............A......R................E......N...INEEG.....  39
bRSV     FY.ILNN...S....TQF...S.......A.....M.E...TPR.QD.YD..KA..EQ...NGV..Y.V.D..T..L..IKNQ...PK.N--DVEL  39
hRSV     FY.ILNN...S....TQF...S.......A.....M.E...TPR.QD.YD..KA..EQ...NGV..Y.V.D..A..L..IKNQ...PKE.—DVEL  39
PVM      FY.I.NN...S....T.....T........A......S.K.APR.R....D..KD..ER..DN.V..Y.A.N..A..R.LISQQ..IV..TPD.DI  39
```

Phospho protein

```
00-1 P   MS-FPEGKDILFMGNEAAKLAEAF--------QKSLRKPGHKRSQSIIGEKVNTVSETLELPTISRPAKPTIPSEPKLAWTDKGGATKTEIKQAIKVMDP  91
APV-A    ..-........H...S....M.D.Y--------.R...NTSAG-GR...S..PI..IA.KVP..PLCN.TT.-----------..SCI.PNKAPVP..K--  76
APV-C    ..-........L.......A....--------.R..K.I..R.T....V.D.II.....V.K....KST.V.T.P.R.N...GE.PDT.RSQTEE.RNEAT.  91
bRSV     .—————................-----------.............................................................  80
hRSV     .EK.APE----.H.ED.MNK.TK.LES--------------IKGKF----------------------ASSKDPKK.DS.ISVNS  45
PVM      .EK.APE----.V.ED.N.K...E..LKHRSFPSE.P.AGIPNTATHVTKYNMPPILRSSFK...SPRVA.NL.E...A.-----PTTPPP..PPQN.EEQPKESD  92

00-1 P   IEEEESTEKKVLPSSDGKTPAEKKLKPSTNT-----KKKVSFTPNEP---GKYTKLEKDALDLLSDNEEEDAE-SSILTFEE---RDTSSLSIEARLESIE  18
APV-A    --.I...IYP.LPTAPVATDTYTSTSTE..AKK-----S...K.DNPKV---.......EEG.E....P..DND.K........--K..A.T........A..  16
APV-C    EDASRLY.EVEA.T.........GKETPEKP------....T.KND.S---.R.....ME..E......DD...-..V.....—K..A..L........D  18
bRSV     ..............................——.............——................-.........——...............  16
hRSV     .DI.VTK.SPITSGTNIIN.TSEADSTPETKANYPR.PL...KEDLTPSDNPFS..Y.ETIETF----DNN—.EE.SYSY..INDQ.-NDN.T...DR.D  13
PVM      VDI.TMHVC...PDNPEHSKKPCCSDDTD.KKT----R.PM.T.VEP.EKFV.LGAS.YRETMQTF---AADGYDEE.N.S...TNQEPG.S.V.Q..DR..  18

00-1 P   EKLSMILGLLRTLNIATAGPTAARDGIRDAMIGVREELIADIIKEA----KGKAAEM---MEEEMXQRSKIGNGSVKLTEKAKELNKIVEDESTSGESEEE  27
APV-A    ........M.K....................M.....NS.MT..—.D.I...—.K..DT..A...D...............L..Q.S.....S.  25
APV-C    .........V................V.L............—.......—.K..AK.K........G.....................  27
bRSV     ...............................——.....——.....X..................................  26
hRSV     ....E...M.H..VV.S.....S.........V.L...H.EK.RA...LMTNDRLFA.ARLRN...SEKMA.DTSDE.P.NPTS..K.SDLL..N------  23
PVM      ....Y.I....N.IMV......T....E....L...T......EM.KSDILTVNDRIVA..EKLRD..CSRADTDDGSACY..DR.RI.D...SSNA------  27

00-1 P   EEPKDTQDNSQEDDIY----QLIM.                                                                          29
APV-A    ..SGESESDEE..S...NLDL-.L                                                                           28
APV-C    ..EE.EEESNPD..L.SLTM-.LIKN                                                                         29
bRSV     ................——.....                                                                           28
hRSV     ----.SDNDLSL.------DF.                                                                             24
PVM      ---EEAKEDLDV...MGINF-.LI                                                                           29
```

FIGURE 4

Matrix protein

FIGURE 4, contd.

```
00-1 matrix MESYLVDTYQGIPYTAAVQVDLIEKDLLPASLTIWFPLFQANTPPAVLLDQLKTLTITTLYAASQNGPILKVNASAQGAAMFVLPKKFEVNATVAXDEYS  10
APV-B       ....II.....V............V....NN..K..V......SS..AP..........S...Q.TV.PE..V.Q...T......SA......S.S.AA.L....  10
APV-A       ....II.....V............SN..T..V......SS..AP..........S...Q.T.PE..V.Q...A......SA......A.S.A..L....  10
APV-C       ...........V......T..V...Q...R..V.V....T....T....E.................SA...S.D.S.S...L.D..  10
bRSV        ..T.VNKLHE.ST......YNV....DD.......V.M..SSISADL.IKE.INVN.LVRQISTLK..S..IMINSRS.VLAQM.S..TIS.N.SL..R.  10
hRSV        ..T.VNKLHE.ST......YNVL...DD.......V.M..SSV.ADL.IKE.ASIN.LVKQISTPK..S.R.TINSRS.VLAQM.SN.IIS.N.SL..R.  10
PVM         ..A...EM.H.V.......LN.V..HSANI...V.I.M..TSL.KNSVM.L.HDV.VICTQISTVH..MI..DL..SSN.GLATM.RQ.LI..II.L.DWG  10

00-1 matrix KLEFDKLTVCEVKTVYLTTMKPYGMVSKFVSSAKSVGKKTHDLIALCDFMDLEKNTPVTIPAFTKSVSIKESESATVEAAISSEADQALTQAKIAPYAGL  20
APV-B       ..D.GV....D.RA.....L.........I.TNMNT..R.........I.M.RGI......Y..A....D..........G.....I...R........  20
APV-A       R...GT....D.RSI....L........IMTDVR..R.........I.I..GV.I...Y..A....D..........G.....I...R........  20
APV-C       ..........L.A..........N...A..........L.....GV....Y..................G.....I...R........  20
bRSV        ..AY.IT.P..I.ACS..CL.VKN.LTTVKDLTMKTFNP..EI....E.ENIMTSKR.V..T.IA.INV.AKQLDSL.NIATT.FKN.I.N....I.....  20
hRSV        ..AY.VT.P..I.ACS..CL.VKS.LTTVKDLTMKTFNP..EI.....E.ENIMTSKR.I..TYLRPI.V.NKDLNSL.NIATT.FKN.I.N...I.....  20
PVM         NMDYEVPVAFDK.SECV.IL..KN.LYTVP.ITPTN-RP...E...V.S.HNRVTLKSFN...V..RALY.RQQGLDS..Q....DV.H.I.T.RV......  19

00-1 matrix IMIMTMNNPKGIFKKLGAGTQVIVELGAYVQAESISKICKTWSHQGTRYVLKSR.                                              25
APV-B       .LL.A.........R..............P.......N..R.....------I---L--K----SR                                 25
APV-A       .L............M.......P.......LG......N..R......R..-.GYPK-A.-IC.C-YSQ.K                            27
APV-C       ...............V..............R..RN.........-----------R                                           25
bRSV        VLVI.VTDN..A..YIKPQS.F..D....LEK...YVVTTN.K.TA.KFSI.P------------IED.                                25
hRSV        VLVI.VTDN..A..YIKPQS.F..D....LEK...YVVTTN.K.TA..FSI.P------------LED.                                25
PVM         TLVINITST..A..L.K..S..ILA...P.LTQV.LHDVIMN.K.T...S.I...SS------------TSG.                            25
```

Fusion protein

```
00-1 F  MSW---KVVIKFSLLI--------TPXHGLKESYLEESCSTITEGYLSVLRTGWYTNVFTLEVGDVENLTCADGPS---LIKTELDLTKSALRELRTVSADQ  88
APV-A   .DV---RICLLLF.IS------N.SSCIQ.T.N......V.R..K............N..I.N...I..N.....----..D...V...N.....K......  88
APV-B   .YL---.LLLIIY.VV------GASGKIQ.T.S......V.R..K............N..I.N...I..N....-----..S...S..QN..Q........  88
APV-C   ...----.LLLV..A------...TG..E.......Y..V.R...............T......-----..R....E...N..E..K......  88
bRSV    .ATTAMRMI.SIIFISTYVTHI.LCQNIT.EFYQST..AVSR....A.........S.V.I.LSKIQKNV.KSTD.KVK...Q..ERYKN.VV..QSLMQNE  10
hRSV    .ELLIHRLSAI.LT.AINALYL.SSQNIT..EFYQST..AVSR..F.A........S.I.I.LSNIKETK.NGTDTKVK...Q...KY.N.VT..QLIMQNT  10
PVM     .----IPGR.FLV..VIFNTKPIHPNT..T.K.Y.ST..VE.A..K.A......HMT.MSIKLSQINIES.KSSN.----.LAH..AIYS..VD....L.SNA  93

00-1 F  IAREEQ------------------IENPRQSREVLGAIAIGVATAAAVTAGVAIAKTIRLESEVTAIKNALKKTNEAVSTLGNGVRVLATAVREIK  16
APV-A   V.K.SR------------------LSS..RR................L.......G..K......RN..................ND..  16
APV-B   ITK.NR------------------.LSH.KK..........T........L..........G..K...L..RS...........I......ND..  16
APV-C   ..K.AR------------------.MS..KA..................G..A..G..R..............ND..  16
bRSV    P.SFSRAKRGIPELIHYTRNSTKKFEYGIMGKK.KR..L--GFL..IG--S..AS...VS.VLH..G..NK.....LS..K..VS.S...S..TSK.LD..  19
hRSV    P.ANNRARREAPQYMNYTINTTKNLNVS.SKK.KR..L--GFL...G--S..LAS.I.VS.VLH..G..NK.....LS..K..VS.S...S..TSK.LD..  19
PVM     -----------LKSK.KK...G--GLI..LG--........L...VQ....IAL.RD.VRN.....VS.T...MS...KV.DD..  16

00-1 F  DFVSKNLTRAINKNKCDIADLKMAVSFSQFNRRFLNVVRQFSDNAGITPAISLDLMTDAELARAVSNMPTSAGQIKIMLENRAMVRRKGFGFLIGVYGSS  26
APV-A   E.I..K..P....Q....N....I....I..G.N............S.....D..V..INR....S...S....N............I......DGT  26
APV-B   E.I..K..P....Q....N...IR..I..G.N............S....S.V..........VK.INR....S....S.....N............I......GT  26
APV-C   ..I..K..P....R.....S........G.Y................................V........S...N............I........  26
bRSV    NYID.E.LPQV.NHD.R.SNIETVIE.Q.K.N.L.EIA.E..V......TPL.TYML.NS..LSLIND..ITND.K...SS.VQI..QQSYSIMSV.KEEV  29
hRSV    NYIMNQ.LPIV.QQS.R.SNIETVIE.Q.K.S.L.EIN.E..V...V.TPL.TYML.NS...LSLIND..ITND.K...SS.VQI..QQSYSIMSIIKEEV  29
PVM     N.I..E.LPK...RVS..VH.ITAVIR.Q.L.K.L.E.S.E...S....L.HTV.SFML...R..TSI.GG.AV.....KEI..SSK.IM..N.LAI.SS.NADT  26

00-1 F  VIKMVQLPIFGVIDTPCWIVKAAPSC--SGKKKGNYACLLREDQGWYCQNAGSTVYYPNEKDCETRGDHVFCDTAAGINVAEQSKECNINISTTNYPCKVS  36
APV-A   .VY...........E....R.V...L--RKE......I.........T.....A......KD...V.D.Y............LEVEQ..Y....SK......  36
APV-B   .VY...........E....R.V...L--RHERES............T.....A.....D...V.D.Y............SEVEQ..H....ST......  36
APV-C   .VYI................K......L--...D................E..V.S................KE.E....R.....K......  36
bRSV    IAYV......Y........KLHTS.L.TTDN.E.SNI..T.T.R....D....VSFF.QTET.KVQSNR.....MNSLTLPTDVNL..TD.FN.K.D..IM  39
hRSV    IAYV......Y........KLHTS.L.TINI.E.SNI..T.T.R....D....VSFF.QADT.KVQSNR.....MNSLTLPSEVSL...TD.FNSK.D..IM  39
PVM     LVYVI...L...M..D...VIRSSID.--HNIADK....A.A.N....H......LS.F.SPT...IHNGYA....LKSLT.PVT.R....S.MY......D...I.  35

00-1 F  TGRHPISMVALSPLGALVACYKGVSCSIGSNRVGIIKQLNKGCSYITNQDADTVTIDNTVYQLSKVEGEQHVIKGRPVSSSFDPVKFPPEDQFNVALDQVF  46
APV-A   .....V.....T...G..S..ES.........K........G....TH.P.NE...I............V...RT....A..VNN.N.IL...........  46
APV-B   .....V.....T...G..S..E..........K..........TH.P.NE...I.....I........V...RT....A..VNN.N.LL...........  46
APV-C   ...............D.M........K.....RP.G.....S.................T....K......N...IE.......I.......  46
bRSV    .SKTD..SSVITSI..I.S..GKTK.TASNKNR....TFSN...D.VS.KGV...SVG...L.YVN.L..KALY....E..IINYY...LV..S.E.DASIA..N  49
hRSV    .SKTD..SSVITS...I.S..GKTK.TASNKNR.....TFSN...D.VS.KGV...SVG...L.YVN.L..KNLYV...E..IINYY...LV..S.E.DASIS..N  49
PVM     .SKTYV.TAV.TTM.C...S..GHN..TVIN.DK.....RT.PD...H...S.KGV.R.QVG....Y......EV.KSI.VR.E.IVLRY..LS...D.K.D...IRD.E  45

00-1 F  ESIENSQALVDQSNRILS-----SAEKGNTGFII--VIILIAVLGSTMILVSVFIIKKTKRPTGAP-PELSGVTNNGFIPH-N.                54
APV-A   ...DR..D.I.K..DL.G----ADA.SKA.IA.---A.VVLVI..IFFL.AVTYYCSRVR.TKPKHDY.ATT.HSSMAYV---------S           53
APV-B   .VDK.KD.I.K..DL.D----IEV.S.I.AAL--A.TILV..SMLI.VGTAYVVV..R.AK.SNGY.RTT.QS.M.Y.S.                     53
APV-C   ..V.K..N.I....K..D----.I.....A..V.--..V..VL.MLAAVG.G..FVV..R.AAPKF.-M.MN...N.K....-.-F.LLKKKKKKKKK    55
bRSV    AK.NQ.L.FIRR.DEL.H---SVDVG.ST.NVV..TTI..V.V.VIIML.A.GLLFYC.TKST.IMLGKDQ.....IN.LS.S---------K.        57
hRSV    .K.NQ.L.FIRR.DEL.H---NVNTG.ST.NIM..TTI..V.I.VLLSL.AIGLLLYC.AKNT.VTLSKDQ...IN.IA.S---------K.          57
PVM     H..NOTRTFFKA.DQL..DLSENREN.NIMKSY.LTTLLFVVM.III.AVIGFILYKVLK----MIRDNK.KSKSTP.LT---------VLS         53
```

L polymerase RAP PCR fragment 8

```
00-1 fragment 8 ---------TVNVYLPDSYLKGVISFSETNAIGSCLLKRPYLKNDNTAKVAIENPVIEHVRLKNAVNSKMKISDYK-----IVEPVNMQHE 77
APV-A           ME-ISNESV.........................V.N...I.D.Y..H..MT......Q..RALFK.LTISRE.R-----V...LMI.K. 84
bRSV            MDTLIHENST....T............C..L..Y..DG......Y.NIISRQK.L...IN..KLSIIQSFVTK.NKGELGLE..TYF.SL 90
hRSV            MDPIINGNSA....T.G..........C..L..YIFNG......Y.NLISRQ..L...MN..KLNITQSL..K.HKGEIKLE..TYF.SL 90

00-1 fragment 8 IM--KNVHSCEL----TLLKQFLTRSKNISTLKLNMICDWLQLK-----------STSDDTSILSFIDVEFI------------------ 13
APV-A           LL--.VAAGAR.----KK..KW.G...D..EV..K.VT...K.S-----------Q.PGRGK.IDR.Q..NL------------------ 13
bRSV            L.TY.SLSTS..ITTT..F.KIIR.AIE..DV.VYA.LNK.G..EKGKVDRC---DDTN.TLSNIVRDNILSVISDNTPSTKKPNNSSCK 17
hRSV            L.TY.SMT.S.QIATTN...KIIR.AIE..DV.VYA.LNK.G..EKDKIKSNNGQDE.NSV.TTI.KDDILSAVKDNQSHLKADKNHSTK 18

00-1 fragment 8 --------------------PSWVSNWFSNWYNLNKLILEFRKEEVIRTGSIL--CRSLGKLVFVVSSYGCIVKSNKSKRVSFFTYNQLL 20
APV-A           --------------------.D.LEH..DS.LI..DV.QSY.CL..SQ.SA..--RK.SLNFF.A...F...II.R..R.IC.C...... 20
bRSV            PDQPIKTTILCKLLSSMSHP.T.LIH..NLYTK..DILTQY.TN.ARNH.Y..IDT.T..EFQ.IINQ.....YHK.L.KITIT....F. 26
hRSV            QKDTIKTTLLKKLMCSMQHP...LIH..NLYTK..NILTQY.SN..KNH.FT.IDNQT.SGFQ.IINQ.....YHKEL..ITVT....F. 27

00-1 fragment 8 TWKDVMLSRFNANFCIWVSNSLNENQEGVGLRSNL-------Q                                                 23
APV-A           ....LA.......L.V....C..SA.D.L....K.VGELLNR                                                  24
bRSV            ....IS...L.VCMIT.I..C..TLNKSL...C                                                           30
hRSV            ....IS...L.VCLIT.I..C..TLNKSL.                                                              30
```

L polymerase RAP-PCR fragment 9/10

```
00-1 fragment 9/10 --KLVDKITSDQHIFSPDKIDMLTLGKMLMP--TIKGQKTDQ-----FLNKRENYFHGNNLIESLSAALAXHWCGILTEQC 72
APV-A              -F.S.R..VT.....N..H..LVM...L.L.--.VRSNINNN------KPAT..F.N...IV.A.TSC..C...TV.ILLT 72
bRSV               -ICKLNQVIQK..M.L....SLSQYVELFLSNK.L.NSPHISSNLVLVH.MSD..LHKYV---..TN..G..IM.IQLMK 76
hRSV               DIHKLKQVIQK..M.L....SLTQYVELFLSNK.L.SGSHVNSNLILAH.ISD...NTYI---..TN..G..IL.IQLMK 77

00-1 fragment 9/10 IENNIFKKDWGDGFISDHAFMDFKIFLCVFKTKLLC                                                10
APV-A              T..S..Q.E......T....IN.TW..MS...Y...HW                                              11
bRSV               DSKG..E....E.Y.T..M.L.LNV.FDAY..Y.                                                  11
hRSV               DSKG..E....E.Y.T..M.INL.V.FNAY..Y                                                   11
```

FIGURE 4, contd.

```
                                                                        50
HMPV   MSLQGIHLSDLSYKHAILKESQYTIKRDVGTTTAVTPSSLQQEITLLCGE
APVC   ......Q........................R.VS.....
APVB   ...ES.R....E......D......R....A...I...E..PKVST...M
APVA   ...ES.R....E......ED.....R....A...I...E..PQVST...M
HRSVA  .A.SKVK.N.TLN.DQL.SS.K...Q.ST.DSIDTPNYDV.KH.NK...M
HRSVB  .A.SKVK.N.TLN.DQL.SS.K...Q.ST.DNIDTPNYDV.KHLNK...M
BRSV   .A.SKVK.N.TFN.DQL.ST.K...Q.ST.DNIDIPNYDV.KHLNK...M
PVM    ...DRLK.N.V.N.DSL.SNCK.SVT.ST.DV.S.SGHAM.KALARTL.M
                                                                        100
HMPV   ILYAKHADYKYAAEIGIQYISTALGSERVQQILRNSGSEVQVVLTRTYSL
APVC   ......T..SH...V.M..V..T..A..T....K......A...K....
APVB   ..F......EP..QV.M........ADKT....KS......G.M.KIVT.
APVA   V.F...T..EP....V.M........AD.T....K......G.M.KIVT.
HRSVA  L.ITED.NH.FTGL..ML.AMSR...R.DTIK...DA.YH.KANGVDVTTH
HRSVB  L.ITED.NH.FTGL..ML.AMSR...R.DTIK..KDA.YH.KANGVDITTY
BRSV   L.ITED.NH.FTGL..ML.AMSR...R.DTLK..KDA.YQ.RANGVDVTTH
PVM    F.LTAFNRCEEV....L..AMSL..RDDSIK...EA.YN..KC.D.QLKDF
                                                                        150
HMPV   GKIKNNKGEDLQMLDIHGVEKSWVEEIDKEARKTMATLLKESSGNIPQNQ
APVC   ..G..S...E..........R...I..V........SAT.DN..P.....
APVB   PAEGPIR--KREV.N..DIGPA.ADNVERT..E..SLMV..K-AQ...K..
APVA   SAEGSVR--KREV.N..D.GVG.ADDVERT.EA.GAMVR.K-VQLTK...
HRSVA  RQDI.G.EMKFEV.TLASLTTEIQIN.EI.S..SYKKM...M-.EVAPEY
HRSVB  RQDI.G.EMKFEV.TLSSLTSEIQVN.EI.S..SYKKM...M-.EVAPEY
BRSV   RQDV.G.EMKFEV.TLVSLTSEVQGN.EI.S..SYKKM...M-.EVAPEY
PVM    TIKLQG.EYKI.V...V.IDAANLADLEIQ..GVV.KE..TG-ARL.D.R
                         A                                              200
HMPV   RPSAPDTPIE|HLCVGALLPTKLF|STIEVGLETTVRRANRVLSDAILKRYPR
APVC   ...S..A...|...I.........|..........A........N.....F..
APVB   K...L.A.V.|...I.........|..V......AI...S......IS....
APVA   K...L.A.V.|...I.........|..V......AI...S......IS....
HRSVA  .HDS..CGM.|I...IA..VI....|AGDRS..TAVI....N..KNEM...KG
HRSVB  .HDS..CGM.|I...IA..VI....|AGDRS..TAVI....N..KNEI...KG
BRSV   .HDS..CGM.|V...A...VI....|AGDRS..TAVI....N..RNEM...KG
PVM    .HD...CGV.|V...IA..VVS...|AGDRG..DAVE...LN..KAEKA...N
                                                                        250
HMPV   MDLEKIARSFYDLFEQKVIHRSLGLEFEVSKALGSSTIGSKAESIIKVNTFMQ
APVC   I.................Y..............................
APVB   ....R..K..FE...K...Y.N...........T.S..RM..........
APVA   ....R..K..FE...K...Y.N...........T....RM..........
HRSVA  LLPKD..N...EV..KHPHFIDV.VHF.I..QS.TRG..RV.GI.AGL..N
HRSVB  LIPKD..N...EV..KHPHLIDV.VHF.I..QS.TRG..RV.GI.AGL..N
BRSV   LIPKD..N...EV..KYPHYIDV.VHF.I..QS.TRG..RV.GI.AGL..N
PVM    .EVKQ..E.......R.P.YIDV...TF.L.QS.VRG...V.G..SGL..N
                B                                      C                300
HMPV   |AYGAGQTMLRWGV|IARSSNNIMLGHVS|VQAEIKQVTEVYDINRENGPESG|
APVC   |............|..............|.......................|
APVB   |........R..|V.............|......R..S.......K......|
APVA   |............|..............|......R..S.......K......|
HRSVA  |.......V....|L.K.VK......A|....ME..V...EYAQKL.G.A.|
HRSVB  |...S..V.....|L.K.VK......A|....ME..V...EYAQKL.G.A.|
BRSV   |.......V....|L.K.VK......A|....ME..V...EYAQKL.G.A.|
PVM    |.......V....|IL.K.VK......A|....ME..V...EYAQKQ.G.A.|
                                                                        350
HMPV   |IHHLRQSPKAGLLSLANCPNFASVVLG|NASGIGIEGMYRGRVPNTELFSA
APVC   |.....N....................|...........L............A.
APVB   |..............TS..........|..A.......K..A..L.......
APVA   |..............T...........|..A.......K..A..L......A.
HRSVA  FY.ILNN...S....TQF.H.S.....|..A....M.E...TPR.QD.YD.
HRSVB  FY.ILNN...S....TQF...S.....|..A....M.E...TPR.QD.YD.
BRSV   FY.ILNN...S....TQF...S.....|..A....M.E...TPR.QD.YD.
PVM    FY.I.NN...S....T......T....|..A.......S.K.APR.R...D.
                                                                        395
HMPV   AESYAKSLKESNKINFSSLGLTDEEKEAAEHFLNVSDDS-QNDYE
APVC   .....R................E.......N...INEEG-.....
APVB   .....R.........LAA....ED.R...TSY.GGDE.K-SQKF.
APVA   .....RT.R.N....LAA......D.R...TSY.GGD.ER-SSKF.
HRSVA  .KA..EQ...NGV..Y.V.D...A...L..IK.Q..PK.N--DVEL-
HRSVB  .KA..EQ...NGV..Y.V.D...A....L..IKNQ..PKE.---DVEL-
BRSV   .KA..EQ...NGV..Y.V.D..T..L..IKNQ..PK.N--DVEL-
PVM    .KD..ER...DN.V..Y.A.N..A...R.LISQQ..IV...TPDD.I-
```

FIGURE 5

```
                                                                          50
HMPV    MSFPEGKDILFMGNEAAKLAEAFQKSLRKPGHKRS--------QSIIGEK
APVC    .............L........A.....R..K.I..R.T--------...V.D.
APVB    ..L.......M..S........Y.Q.IKNSTSV.--------R...S.DP
APVA    ...........M..S....M.D.Y.R...NTSAGG--------R...S..P
HRSVA   ---M.KFAPE.H.ED.NNR.TK.LE.---------------------
HRSVB   ---M.KFAPE.H.ED.NNK.TK.LE.---------------------
BRSV    ---M.KFAPE.H.ED.NTK.TK.LE.---------------------
PVM     ---M.KFAPE.V.ED.N.K..E.L.HRSF.SE.PLAGIPNTATHVTKYNM
                                                                         100
HMPV    VNTVSETLELPTISRPAKPTIPSEPKLAWTDKGGATKTEIKQAIKVMDPI
APVC    II......V.K....KST.V.T.P.R.N..GE.PDT.RSQTEE.RNEAT.E
APVB    .S....KVP..PLCSSETS-----------R.ACIRPT-.STLPPIK--
APVA    I...IA.KVP..PLCN.TT.-------------SCI.PN-.APVPKVK--
HRSVA   ---IKGKFTS.-----------------------KDPKK.DS.ISVNS.
HRSVB   ---IKGKFASS----------------------KDPKK.DS.ISVNS.
BRSV    ---LKGKFTSS----------------------KDSRK.DS.ISVNSV
PVM     PPILRSSFK..SPRVA.NL.E..A.P----TTPPP.PPQN.EEQPKESDV
                                                                         150
HMPV    EEEESTEKKVLPSSDGKTPAEKKLKPSTNTKKK------VSFTPNEPGKYT
APVC    DASRLY.EVFA.T.........GKETPEKP...------.T.KND.S.R..
APVB    .V.SIYP.LPTAPP.AMIETAHPIGAPKKAQ.R------.K.ESSKA....
APVA    .I.SIYP.LPTAPVATD.YTSTSTESAKKS..------.K.DNPKV....
HRSVA   DI.VTK.SPITSN.TIIN.TNETDDTAG.KPNYQRKPL...KEDPTPSDN
HRSVB   DI.VTK.SPITSGTNIIN.TSEADSTPETKANYPRKPL...KEDLTPSDN
BRSV    DI.LPK.SPITSTNQNINQPSEINDTIATNQVHIRKPL...KEEL.SSEN
PVM     DI.TMHVC..PDNPEHSKKPCCSDDTD.KKT---RKPM.T.VEP.EKFVG
                                                                         200
HMPV    KLEKDALDLLSD-NEEEDAESSILTFEERD--TSSLSIEARLESIEEKLS
APVC    ...ME..E.---...DD.....V.....K.--..A..L........D...
APVB    ...EE..E....PD.DN.EK..V.....K.--NAPS........A.....
APVA    ...EEG.E....PE.DN.EK........K.--.A.T........A.....
HRSVA   PFS.LYKETIETFDNN--E.E.SYSY..INDQ.NDN-.T...DR.D....
HRSVB   PFS.LYKETIETFDNN--E.E.SYSY..INDQ.NDN-.T...DR.D....
BRSV    PFTRLYKETIETFDNN--E.E.SYSYD.INDQ.NDN-.T...DR.D....
PVM     LGASLYRETMQTFAADGYD.E.N.S...TNQEPG.S.V.Q..DR......
                                                                         250
HMPV    MILGLLRTLNIATAGPTAARDGIRDAMIGVREELIADIIKEAKGK-----
APVC    ..........V.................V.L...........-----
APVB    ....M.K..S..................V.......NS.MA...-----
APVA    ....M.K....................M.......NS.MT...D.-----
HRSVA   E...M.H..VV.S....S...........L...M.EK.RT..LMTNDRLE
HRSVB   E...M.H..VV.S....S.........V.L...M.EK.RA..LMTNDRLE
BRSV    E.I.M.H..VV.S...............V.L...M.EK.RS..LMTNDRLE
PVM     Y.I...N.IMV......T...E....L..T.....EM.KSHILTVNDRIV
                                                                         300
HMPV    -AAEMMEEEMSQRSKIGNGSVKLTEKAKELNKIVEDESTSGESEEEEPR
APVC    -.....K..AK.K...........G................EE
APVB    -I..IIK..DA..A...D..........R...RML.QIS..HTS.ET
APVA    -I....K..DT..A...D..............L..QIS...SG
HRSVA   AM.RLRN..SEKMA.DTSDE.S.NPTSEK..NLL.G-----------N
HRSVB   AM.RLRN..SEKMA.DTSDE.P.NPTS.K.SDLL..-----------N
BRSV    AM.RLRD..SEKMT.DTSDE....PTSEK..MVL...-----------E
PVM     AMEKLRD..C.RADTDDGSACY..DR.RI.D...SSNA----------E
                       316
HMPV    DTQDNSQEDDIYQLIM
APVC    .IBEESNPD..L.S.T.
APVB    EPDTDGEN....SFD.
APVA    ESPSDEEJS...N.DL
HRSVA   .SDNDLSLE.F-----
HRSVB   .SDNDLSL..F-----
BRSV    SSDNDLSLE.F-----
PVM     EAKEDLDV...MGINF
```

FIGURE 6

```
                                                                          50
HMPV   MESYLVDTYQGIPYTAAVQVDLIEKDLLPASLTIWFPLFQANTPPAVLLD
APVC   ...........V.......T..V...Q...R..V.V....T....T...E
APVB   ....II.....V.........V...NN..K..V......SS..AP....
APVA   ....II.....V...........SN..T..V......SS..AP....
HRSVA  ..T.VNKLHE.ST......YNVL...DD.......V.M..SSM.ADL.IK
HRSVB  ..T.VNKLHE.ST......YNVL...DD.......V.M..SSV.ADL.IK
BRSV   ..T.VNKLHE.ST......YNV....DD.......V.M..SSISADL.IK
PVM    ..A...EM.H.V.......LN.V..HSANI...V.I.M..TSL.KNSVM.
                                                                         100
HMPV   QLKTLTITTLYAASQNGPILKVNASAQGAAMSVLPKKFEVNATVALDEYS
APVC   ...........T....................A...S.D.S.S....D..
APVB   .....S...Q.TV.PE..V.Q...T.......A......S.S.AA.....
APVA   .....S...Q.T..PE..V.Q...A.......A......A.S.A......
HRSVA  E.ANVN.LVKQISTPK..S.R.MINSRS.VLAQM.S..TIC.N.S...R.
HRSVB  E.ASIN.LVKQISTPK..S.R.TINSRS.VLAQM.SN.IIS.N.S...R.
BRSV   E.INVN.LVRQISTLK..S..IMINSRS.VLAQM.S..TIS.N.S...R.
PVM    L.HDV.VICTQISTVH..MI..DL.SSN.GLATM.RQ.LI..II...DWG
                                                                         150
HMPV   KLEFDKLTVCEVKTVYLTTMKPYGMVSKFVSSAKSVGKKTHDLIALCDFM
APVC   ...........L.A...............N...A..............L
APVB   ..D.GV....D.RA.....L........I.TNMNT..R...........I
APVA   R...GT....D.RSI....L........IMTDVR...R...........I
HRSVA  ..AY.VT.P..I.ACS..CL.SKN.LTTVKDLTMKTLNP...I....E.E
HRSVB  ..AY.VT.P..I.ACS..CL.VKS.LTTVKDLTMKTFNP..EI....E.E
BRSV   ..AY.IT.P..I.ACS..CL.VKN.LTTVKDLTMKTFNP..EI....E.E
PVM    NMDYEVPVAFDK.SFCV.IL..KN.LYTVP.ITP-TNRP..E...V.S.R
                                                                         200
HMPV   DLEKNTPVTIPAFIKSVSIKESESATVEAAISSEADQALTQAKIAPYAGL
APVC   ....GV......Y..................G.....I...R.......
APVB   .M.RGI......Y..A....D..........G.....I...R.......
APVA   .I..GV.I....Y..A....D..........G.....I...R.......
HRSVA  NIVTSKK.I...TYLR.I.VRNKDLN.L.NITTT.FKN.I.N....I..S..
HRSVB  NIMTSKR.I...TYLRPI.V.NKDLNSL.NIATT.FKN.I.N...I.....
BRSV   NIMTSKR.V...T.LR.INV.AKDLDSL.NIATT.FKN.I.N...I.....
PVM    NRVTLKSFN..V..RALY.RQQGLDS..Q....DV.H.I.T.RV......
                                                                         250
HMPV   IMIMTMNNPKGIFKKLGAGTQVIVELGAYVQAESISKICKTWSHQGTRYV
APVC   ...................V................R..RN........
APVB   .LL.A........R.............P......LG......N..R...I
APVA   .L.................M.......P......LG......N..R....
HRSVA  LLVI.VTDN..A..YIKPQS.F..D....LEK...YYVTTN.K.TA...FA
HRSVB  VLVI.VTDN..A..YIKPQS.F..D....LEK...YYVTTN.K.TA...FS
BRSV   VLVI.VTDN..A..YIKPQS.F..D....LEK...YYVTTN.K.TA.KFS
PVM    TLVINITST..A..L.K..S.ILA...P.LTQV.LHDVIMN.K.T...S.I
           258
HMPV   LKSR----
APVC   ....----
APVB   ....----
APVA   .R..----
HRSVA  I.PMED--
HRSVB  I.PLED--
BRSV   I.PIED--
PVM    ...SSTSG
```

FIGURE 7

```
              Signal peptide                                                                          100
HMPV    ---------MSWKVVIIFSLLITPQHGLKESYLEES CSTITEGYLSVLRTGWYTNVFTLEVGDVENLT CADGPS---LIKTELDLTKSALRELRTVSADQ
APVC    ---------......LLLV..A..TG..E...... Y..V.R............................ T....---..R...E...N..E..K......
APVB    ---------.YL.LLL.IY.VVGASGKIQ.T.S... ...V.R..K............N..I.N...I. N......---..S...S..QN..Q........
APVA    ---------.DVRICLLLF.ISN.SSCIQ.T.N... ...V.R..K............N..I.N...I. N......---..D...V...N.......K......
HRSVA   MELLILKANAITTILTAVTFCFASGQNIT.EFYQST ..AVSK....A........S.I.I.LSNIKENH .NGTDAKVK...Q...KY.N.VT..QLLMQST
HRSVB   MELLII:RLSAIFLTLA.NA.YL.SSQNIT.EFYQST ..AVSR..F.A........S.I.I.LSNIKETH .NGTDKVK...Q...KY.N.VT..QLLMQNT
BRSV    MATTAMRMII.IIFISTYVTH..LCQNIT.EFYQST ..AVSR....A........S.V.I.LSKIQKNV .KSTD.KVK...Q...ERYNN.VV..QSLMQNE
PVM     ----MIPGRIFLVLLV..NTKPIHPNT.T.K.Y.ST ..VE.A...K.A......HMT.MSIKLSQINIES KSSN.---.LAH..AIYS..VD....L.SN- Fusion domain                           HRA                      200
HMPV    LAREEQ---------------IENPRQSR FVLGAIALGVATAAAVTAGVAIAKTIRLESEVTAIKNALKKTNEAVSTLGNGVRVLATAVRELK
APVC    ..K.AR--------------.MS..KKI ............G..A...G..R...............ND..
APVB    ITK.NR--------------.LSH.KKI ............T........L.....G..K..L..RS.............ND..
APVA    V.K.SR--------------.LSS..KKI ............L........L.....G..K......RN.........I....ND..
HRSVA   PPTNNRARRELPRFMNYTLNNAKKTNVTLSKK.KRI ..LG--FL...G--S.IAS...VS.VLH..G..NK..S..LS..K..VS.S....S..TSK.LD..
HRSVB   P.ANNRARREAPQYMNYTINTTKNLNVS.SKK.KRI ..LG--FL...G--S.IAS.I.VS.VLH..G..NK.....LS..K..VS.S....S..TSK.LD..
BRSV    P.SFSRAKRGIPELIHYTRNSTKKFYGLMGKK.KRI ..LG--FL...IG--S..AS...VS.VLH..G..NK.....LS..K..VS.S....S..TSK.LD..
PVM     -----------------ALKSK-.KKI ..LG--LI..LG--..........L....VQ......IAL.RD.VRN.....VS.T..MS...KV.DD..

300
HMPV    DFVSKNLTRAINKNF CDIADLKMAVSFSQFNRRFLNVVRQFSDNAGITPAISLDLMTDAELARAVSNMPTSAGQIKLMLENRAMVRRKGFGFLIGVYGSS
APVC    ..I..K..P...R.. ..S..........G.Y........................V.......S..N..................I.........
APVB    E.I..K..P...Q.. .N..IR..I..G.N...............S.....S.V..........VK.INR....S....S....N...........I........GT
APVA    E.I..K..P...Q.. .N...I...I..G.N...............S.....S.V........D..V..INR....S....S....N...........I.....DGT
HRSVA   NYID.Q.LPIV..QS .S.SNIETVIE.Q.K.N.L.EIT.E..V...V.TPV.TYML.NS..LSLIND..ITND.K...SN..VQI..QQSYSIMSIIKEEV
HRSVB   NYINNQ.LPIV.QQS .R.SNIETVIE.Q.K.S.L.EIN.E..V.....V.TPL.TYML.NS..LSLIND..ITND.K....SS.VQI..QQSYSIMSIIKEEV
BRSV    NYID.E.LPQV.NHD .R.SNIETVIE.Q.K.N.L.EIA.E..V.....TPL.TYML.NS..LSLIND..ITND.K...SS.VQI..QQSYSIMSV.KEEV
PVM     N.I..E.LPK..RVS .VH.ITAVIR.Q.L.K.L.E.S.E...S...L.HTV.SFML..R..TSI.GG.AV....KEI..SSK.IM..N.IAI.SS..NADT

400
HMPV    VIYMVQLPIFGVIDT CWIVKAAPS CSG--KKGNYA CLLREDQGWY CQNAGSTVYYPNEKD CETRGDHVI CDTAAGINVAEQSKI CNINISTTNYI CKVS
APVC    .V.I.......... .K......I ...---D... ............ ..........  ......E... ...KE.E.. .R......K. .....
APVB    .V..........E. ..R.V.....I .RH--ERES. .............. .T.....A......D .V.D.Y.. ...........SEVEQ .H....ST. .....
APVA    .V..........E. ..R.V.....I .RK--E....  ............. .T.....A......KD .V.D.Y.. ...........LEVEQ .Y....SK. .....
HRSVA   LA.V....LY..... ..KLHTS.I .TTNT.E.SNI ............. .D....VSFF.QAET .KVQSNR.. ....MNSLTLPSEINI .VD.FNPK.D .IM
HRSVB   LA.V.....Y..... ..KLHTS.I .TTNI.E.SNI ............. .D....VSFF.QADT .KVQSNR.. ....MNSLTLPSEVSI .TD.FNSK.D .IM
BRSV    IA.V.....Y..... ..KLHTS.I .TTDN.E.SNI ............. .D....VSFF.QTET .KVQSNR.. ....MNSLTLPTDVNI .TD.FN.K.D .IM
PVM     LV.VI...L...M..D .VIRSSII .HN--IADK. .J.A..A.N... .H.....LS.F.SPT .J.IHNGYA .J...LKSLT.PVT.R .J.S.MY....D .I.

500
HMPV    TGRHPISMVALSPLGALVA CYKGVS CSIGSNRVGIIKQLNKG CSYITNQDADTVTIDNTVYQLSKVEGEQHVIKGRPVSSSFDPVKFPEDQFNVALDQVF
APVC    ............... ..D.M. .....K...RP.G. ..S................T...K....N...IE........I......
APVB    .....V.....T...G..S .E... ......K......... TH.P.NE....I......I......V...RT....A..VNN.N.LL.............
APVA    .....V.....T...G..S .ES... ......K......... TH.P.NE....I......I......V...RT....A..VNN.N.IL.............
HRSVA   .SKTDV..SSVITS...I.S .GKTK TASNKNR....TFSN. .D.VS.KGM...SVG..L.YVN.Q..KSLYV..E..IINFY..LV..S.E.DASIS..N
HRSVB   .SKTD...SSVITS...I.S .GKTK TASNKNR....TFSN. .D.VS.KGV...SVG..L.YVN.L..KNLYV..E..IINYY..LV..S.E.DASIS..N
BRSV    .SKTD...SSVITSI..I.S .GKTK TASNKNR....TFSN. .D.VS.KGV...SVG..L.YVN.L..KALY...E..IINYY..LV..S.E.DASIA..N
PVM     .SKTYV.TAV..TTM.C..S .GHN. TVIN.DK....RT.PD. .H...S.KGV.R.QVG....Y....EV.KSI.VR.E.LVLKY...LS...D.K.D..IRD.E

HRB                              Membrane anchor                                           583
HMPV    ESIENSQALVDQSNRILSSAE----KGNTGFIIVIILIAVLCSTMILVSVFTIIKKTKKPTG---AP-PELSGVTNNGFIPHN
APVC    ..V.K..N.I....K..D.I.----......A...V...V..VL.MLAAVG..G..FVV...R.AAPK---F..M.MN..N.K.....--
APVB    ..VDK.KD.I.K..DL.DIEV----.S.I.AALA.TILV..SMLI.VGIAYYVV..R.AK.S---NGY.KTT..QS.M.Y.S---
APVA    ...DR..D.I.K..DL.GADA----.SKA..IA.A..VVLVI..IFFL.AVIYYCSRVR.TKPK---HDY.ATT..HSSMAYVS--
HRSVA   .K.NO.L.FIRK.DEL.HNVN--AG.ST.NIM.TT.I.VIIVILLS.IA.GLLLYCKARS.P-VTLSKDQ...IN.IA.SN--
HRSVB   .K.NO.L.FIRK.DEL.HNVN--TG.ST.NIM.TT.I.VIIVVLLS.IAIGLLLYCKA.N.P-VTLSKDQ...IN.IA.SK--
BRSV    AK.NO.L.FIRR.DEL.H.VD--VG.ST.NVV.TT.I.VIVVVILM.IA.GLLFYCKT.S.P-IMLGKDQ...IN.LS.SK--
PVM     H..NOTRTFFKA.DQL.DLS.NREN.NLNKSY.LTT..LF.VMLII.MAVIGF..LY..VL.MIRDNKLKSKSTP..L.VLS------
```

FIGURE 9

A

```
               #      #   #                                 50
HMPV   MSRKAPCKYEVRGKCNRGSECKFNINYWSWPDRYLITKSNYLLNQLLRNT
APVC   ..............................L..................
APVB   ..GRN..R..T..R.....S.T..........HV..V.A..M....V...
APVA   ...RN..R..I........S.T..........HV..V.A..M........
HRSVA  ...RN...F.I..H.LN.KR.H.S...FE..PHA..V.Q.FM..RI.KSM
HRSVB  ...RN...F.I..H.LN.RR.HYS...FE..PHA..V.Q.FM..KI.KSM
BRSV   ...RN.....I..H.LN.KK.H.S...FE..PHA..V.Q.FM..KI.KSM
PVM    ..VR-...F..Q.F.S..RN..YS.K..E..LKT.ML.Q..M..RIY.FL
                   #                                      100
HMPV   DRAHDGLSITSGAGREDRTQDFVLGSTNVVQGYIDDNQSITKAAACYSLH
APVC   ..S-....L......D..............N...N,EN....ST....Y
APVB   ..T-....L.................A....N..EG.AT...S......Y
APVA   ..T-....L.................A....N..EG.TT...S......Y
HRSVA  .KSI.T..E....AEL...EEYA..VVG.LES..GSINN...QS..VAMS
HRSVB  .KSI.T..E....AEL...EEYA..IVG.LES..GSINN...QS..VAMS
BRSV   ..NN.T..E....AEL...EEYA..VIG.LES..LGSINN...QS..VAMS
PVM    .TNT.AI.DV..FDAPQ..AEYA..TIG.LKS.LEKTNN...SI..G..I
                                                          150
HMPV   NIIKQLQEVEVRQARDNKLSDSKHVALHNLVLSYMEMS-KTPASLINNLK
APVC   ........TD.........VD................-............
APVB   ........ND.KS...LMVD.P..........:.....ID..-.N..N...S..
APVA   ........ND.KTS..SM.E.P..........I...VD..-.N.......S..
HRSVA  KLLTE.NSDDIKKL...EELN.PKIRVY.T.I...I.SNR.NNKQT.HL..
HRSVB  KLLIEINSDDIKKL...EEPN.PKIRVY.T.I...I.SNR.NNKQT.HL..
BRSV   KLLAEINNDDIKRL.NKEVPT.PKIRIY.T.I...IDSNKRNTKQT.HL..
PVM    TVLQN.DVGL.I....SNTE.TNYLRSC.TI...IDKIL.K-RQI.HI..
                                                          195
HMPV   RLPREKLKKLAKLIIDLSAGAE--NDSSYALQDSESTNQVQ----
APVC   K..K...........E....V.--...TA.M...ANSD-------
APVB   ...K........I..Q....S.GE.AN.NT..KGD.S.--------
APVA   ............I.LQ....P.SD.A.GNT..KGD.N.--------
HRSVA  ...ADV...TI.NTL.IHKSITIN.PKESTVS.TNDHAKNNDTT-
HRSVB  ...ADV...TI.NTL.IHKSIIIS.PKESTVN.QNDQTKNNDITG
BRSV   ...ADV...TI.NT..IHNEINGN.QGDIIVNEQNE---------
PVM    ...VGV.CN.IQSV.SIEEKINSSMKTE-----------------
```

B

```
                                                          50
HMPV   --------MTLHMP-CKTVKALIKCS--------EHGPVFITIEVDDMIW
APVC   ---------...QL.-..I.QT....G---------...LI.LKMKL...V.
APVB   ---------.PIVI.-..R.T.V.R.N--------TL.VCLFKRTYEHN.I
APVA   ---------.PVVI.-..RR.T.I...N-------AL.LCMVRKIY.YS.A
HRSVA  MTMPKIMILPDKY.-.SITSI..TSRCRVTMYNQKNTLY.NQNNPNNHMY
HRSVB  MTKPKIMILPDKY;-.SISSI..SSESMIATFNHKNILQ.NHNHL.NHQR
BRSV   MNNSNIIIFPEKY.-.SISSL...NENDVIVLSHQNVLDYLQFQYPCNMY
PVM    MQSDPICHLHRGEDKFFYENRM.RLPKYYPAILHKMYIIRVNRNLTYDGS
                                                          97
HMPV   THKDLKEA---L---SDGIVKSHTNIYNCYLENIEIIYVKAYLS----
APVC   .KNE.VDI---I---.TE...V.A..FK.R..D.......TF..----
APVB   NLG..I.E---V---ARM.IID.I.RKQ.NECRKDFEF.AV.T.YT--
APVA   SWS..I.E---V---ANMVLID.I.RKQ.VECRKDFEFIAI.T.YN--
HRSVA  SPNQTFNE---IHWT.QELIDTIQ.FLQHLGIIED.YTIYILV.----
HRSVB  LLNNIFDE---IHWTPKNLLDATQQFLQHLNIPED.YTIYILV.----
BRSV   SQNHMLDD---IYWT.QELIEDVLK.LHLSGIS.SKYVIYVLVL----
PVM    GPSTIID.GKSVVWNRVDVIACVKEALC.IEFSWNNQVIIDFDYSQAR
```

FIGURE 10

```
              A                                             674
HMPV  NYIARA SIVTDLSKFNQAE RYETTAICADVADELHGTQSLFCWLHLIVPM
APVA  .....|..............|.....SV...................T..SS
HRSVA ...SKC|..I..........|.....SC..S..L.....V....F....AI.H
HRSVB ...SKC|..I..........|.....SC..S..L.....V....S....TI.L
BRSV  ...SKC|..I..........|.....SC..S..L.....V....S....TI.F
HPIV2 FELSAC|F.T...A.YCLQW|..Q.IIHF.RTLNRMY.VPH..E.I..RLIR
NDV   RRRVAT|F.T...Q.YCLNW|..Q.IKLF.HAINQ.M.LPHF.E.I..RLMD
SV    YETLSC|FLT...K.YCLNW|.F.S..LFGQRCN.IF.FKTF.N.M.PVLEK
HPIV3 YETVSC|FLT...K.YCLNW|...S..LFGETCNQIF.LNK..N...PRLEG
MV    YETVS.|F.T...K.YCLNW|....ISLF.QRLN.IY.LP.F.Q...KRLET
NIPAH FDTVS.|FLT...K..CLNW|...SM..F.ERL..IY.LPGF.N.M.KRLER
                                       B              723
HMPV  TTMICAYRHAPPETKG-EYDIDKIEEQS GLYRYHMGGIEGWCQKLWTMEA
APVA  .....T......D.G.-I....Q.P...|....F...........M.....
HRSVA V.I..T......YIRDHIV.LNNVD...|...................I..
HRSVB V.I..T......FI.DHVVNLNEVD...|...................I..
BRSV  A.V..T......YIRNHIT.LN.VD...|...................I..
HPIV2 S.LYVGDPFN..AATD-AF.L..VLNGD|IFIVSK-.....L...M...IS
NDV   ...FVGDPFN..SDPT-DC.LSRVPNDD|IYIVSAR.....L........IS
SV    C.IYVGDPYC..VADRM-HRQLQDHADSG|IFIHNPR.....Y......LIS
HPIV3 S.IYVGDPYC..SD.E-HISLEDHPDSG|FYVHNPR.....F......LIS
MV    SVLYVSDP.C..DLDA-HIPLY.VPNDG|IFIK.P......Y.......IST
NIPAH SVIYV.DPNC..NIDK-HMELE.TP.DI|IFIH.PK.....YS..T..IAT
                C                                      772
HMPV  ISLL DVVSVKTRCQMT SLLNGDNQSI DVSKPVKLSEG-LDEVKADYSLAV
APVA  ....|......RN.V.L|..........|......R.TGA-QT.IQ......I
HRSVA ....|.LI.L.GKFSI.|A.I.......|.I....R.M..-QTHAQ...L..L
HRSVB ....|.LI.L.GKFSI.|A.I.......|.I....R.I..-QTHAQ...L..L
BRSV  ....|.LI.I.GKFSI.|A.I.......|.I...I..N..-QTHAQ...L..L
HPIV2 ..VI|LS.AESKTRVM.|MVQ....A.A|.TTR.PR.LPSIQKKELA.AASK
NDV   .AAI|QLAAARSH.RVA|CMVQ....V.A|.TRE.RSDDSPEMVLTQLHQASD
SV    ..AI|HLAA.RVGVRVS|AMVQ....A.A|.TSR.PVAQTYKQKKNHV.EEIT
HPIV3 ..AI|HLAA.RIGVRV.|AMVQ....A.A|.TTR.PNNYDYRIKKEIV.KDV.
MV    .PY.|YLAAYESGVRIA|..VQ....T.A|.T.R.PSTWPYNLKKREAARVTR
NIPAH .PF.|FLSAYE.NTRIA|AIVQ....E..|AITQK.HPNLPYKVKKEICAKQ.Q
                                          D           822
HMPV  KMLKEIRDAYRNIGHKLKEGETYISRDLQFISKVI QSEGVMHPTPIKKIL
APVA  ...TAV.....Y............V......M..T.|......Y.AA...V.
HRSVA NS..LLYKE.AG......GT........M..M..T.|.HN..YY.AS...V.
HRSVB NS..LLYKE.AG......GT........M..M..T.|.HN..YY.AS...V.
BRSV  .S..LLYKE.AS......GT........M..M..T.|.HN..YY.AS...V.
HPIV2 LFFERL.ANNYGL..Q..AQ..I..STFFIY..RV|FYQ.RILTQAL.NFS
NDV   NFF...LIHVNHL...N..DR..IR.DTFFIY..R.|FKD.AILSQVL.NSS
SV    RYFGAL.HVMFD...E..LN..I..SKMFVY..R.|YYD.KIL.QCL.ALT
HPIV3 RFFDSL.EVMDDL...E..LN..I..SKMFIY..R.|YYD.RIL.QAL.AIS
MV    DYFVIL.QRLHD...H..AN..IV.SHFFVY..G.|YYD.LLVSQSL.S.A
NIPAH LYFERL.MNL.AL..N..AT..I..TH.FIY..K.|HYD.AVLSQAL.SMS
                847
HMPV  RVGPWINTILDDIKTSAESIGSLCQ
APVA  ...............M.A......
HRSVA ............F.V.L......T.
HRSVB ............F.V.L......T.
BRSV  ............F.V.M......T.
HPIV2 KLCLTADVLGECTQA..CSNSATTIM
NDV   KLVLVSGDLSENTVM..CAN.A.TVA
SV    .CVF.SE..LV.ENRSACSN.STSIA
HPIV3 .CVF.SE..VI.ETRSASSNLATSFA
MV    .CVF.SE...V.ETRAACSN.ATTMA
NIPAH .CCF.SE..LV.ETRSACSN.STTIA
```

FIGURE 13

Alignment: F DNA

```
             ....|....| ....|....| ....|....| ....|....| ....|....| ....|....|
                  5         15         25         35         45         55
NL/1/00      ATAGGAGTTT ACGGAAGCTC CGTAATTTAC ATGGTGCAAC TGCCAATCTT TGGGGTTATA
UK/1/00      ATAGGAGTTT ACGGAAGCTC CGTAATTTAC ATGGTGCAAC TGCCAATCTT TGGGGTTATA
NL/2/00      ATAGGAGTTT ACGGAAGCTC CGTAATTTAC ATGGTGCAAC TGCCAATCTT TGGGGTTATA
NL/13/00     ATAGGAGTTT ACGGAAGCTC CGTAATTTAC ATGGTGCAAC TGCCAATCTT TGGGGTTATA
NL/14/00     ATAGGAGTTT ACGGAAGCTC CGTAATTTAC ATGGTGCAAC TGCCAATCTT TGGGGTTATA
FL/3/01      ATAGGAGTTT ACGGAAGCTC CGTAATTTAC ATGGTGCAAC TGCCAATCTT TGGGGTTATA
FL/4/01      ATAGGAGTTT ACGGAAGCTC CGTAATTTAC ATGGTGCAAC TGCCAATCTT TGGGGTTATA
FL/8/01      ATAGGAGTTT ACGGAAGCTC CGTAATTTAC ATGGTGCAAC TGCCAATCTT TGGGGTTATA
UK/1/01      ATAGGAGTTT ACGGAAGCTC CGTAATTTAC ATGGTGCAAC TGCCAATCTT TGGGGTTATA
UK/7/01      ATAGGAGTTT ACGGAAGCTC CGTAATTTAC ATGGTGCAAC TGCCAATCTT TGGAGTTATA
FL/10/01     ATAGGAGTTT ACGGAAGCTC CGTAATTTAC ATGGTGCAAC TGCCAATCTT TGGGGTTATA
NL/6/01      ATAGGAGTTT ACGGAAGCTC CGTAATTTAC ATGGTGCAAC TGCCAATCTT TGGAGTTATA
NL/8/01      ATAGGAGTTT ACGGAAGCTC CGTAATTTAC ATGGTGCAAC TGCCAATCTT TGGGGTTATA
NL/10/01     ATAGGAGTTT ACGGAAGCTC CGTAATTTAC ATGGTGCAAC TGCCAATCTT TGGAGTTATA
NL/14/01     ATAGGAGTTT ATGGAAGCTC CGTAATTTAC ATGGTGCAAC TGCCAATCTT TGGAGTTATA
NL/20/01     ATAGGAGTTT ATGGAAGCTC CGTAATTTAC ATGGTGCAAC TGCCAATCTT TGGAGTTATA
NL/25/01     ATAGGAGTTT ACGGAAGCTC CGTAATTTAC ATGGTGCAAC TGCCAATCTT TGGAGTTATA
NL/26/01     ATAGGAGTTT ATGGAAGCTC CGTAATTTAC ATGGTGCAAC TGCCAATCTT TGGAGTTATA
NL/28/01     ATAGGAGTTT ATGGAAGCTC CGTAATTTAC ATGGTGCAAC TGCCAATCTT TGGAGTTATA
NL/30/01     ATAGGAGTTT ATGGAAGCTC CGTAATTTAC ATGGTGCAAC TGCCAATCTT TGGAGTTATA
BR/2/01      ATAGGAGTTT ACGGAAGCTC CGTAATTTAC ATGGTGCAAC TGCCAATCTT TGGGGTTATA
BR/3/01      ATAGGAGTTT ACGGAAGCTC CGTAATTTAC ATGGTGCAAC TGCCAATCTT TGGGGTTATA
NL/2/02      ATAGGAGTTT ACGGAAGCTC CGTAATTTAC ATGGTGCAAC TGCCAATCTT TGGAGTTATA
NL/4/02      ATAGGAGTTT ACGGAAGCTC CGTAATTTAC ATGGTGCAAC TGCCAATCTT TGGGGTTATA
NL/5/02      ATAGGAGTTT ACGGAAGCTC CGTAATTTAC ATGGTGCAAC TGCCAATCTT TGGAGTTATA
NL/6/02      ATAGGAGTTT ACGGAAGCTC CGTAATTTAC ATGGTGCAAC TGCCAATCTT TGGAGTTATA
NL/7/02      ATAGGAGTTT ACGGAAGCTC CGTAATTTAC ATGGTGCAAC TGCCAATCTT TGGGGTTATA
NL/9/02      ATAGGAGTTT ATGGAAGCTC CGTAATTTAC ATGGTGCAAC TGCCAATCTT TGGAGTTATA
FL/1/02      ATAGGAGTTT ACGGAAGCTC CGTAATTTAC ATGGTGCAAC TGCCAATCTT TGGGGTTATA
NL/1/81      ATAGGGGTCT ACGGGAGCTC TGTAATTTAC ATGGTGCAGC TGCCAATCTT TGGCGTTATA
NL/1/93      ATAGGGGTCT ACGGGAGCTC CGTAATTTAC ATGGTGCAGC TGCCAATCTT TGGCGTCATA
NL/2/93      ATAGGGGTCT ACGGGAGCTC CGTAATTTAC ATGGTGCAGC TGCCAATCTT TGGCGTCATA
NL/4/93      ATAGGGGTCT ACGGGAGCTC CGTAATTTAC ATGGTGCAGC TGCCAATCTT TGGCGTCATA
NL/1/95      ATAGGGGTCT ACGGGAGCTC CGTAATTTAC ATGGTGCAGC TGCCAATCTT TGGCGTTATA
NL/2/96      ATAGGGGTCT ACGGGAGCTC CGTAATTTAC ATGGTGCAGC TGCCAATCTT TGGCGTTATA
NL/3/96      ATAGGGGTCT ACGGGAGCTC CGTAATTTAC ATGGTGCAGC TGCCAATCTT TGGCGTTATA
NL/1/98      ATAGGGGTCT ACGGGAGCTC CGTAATTTAC ATGGTGCAGC TGCCAATCTT TGGCGTTATA
NL/17/00     ATAGGGGTCT ACGGGAGCTC CGTAATTTAC ATGGTGCAGC TGCCAATCTT TGGCGTTATA
NL/22/01     ATAGGGGTCT ACGGGAGCTC CGTAATTTAC ATGGTGCAGC TGCCAATCTT TGGCGTTATA
NL/29/01     ATAGGGGTCT ACGGGAGCTC CGTAATTTAC ATGGTGCAGC TGCCAATCTT TGGCGTTATA
NL/23/01     ATAGGGGTCT ACGGGAGCTC CGTAATTTAC ATGGTGCAGC TGCCAATCTT TGGCGTTATA
NL/17/01     ATAGGGGTCT ACGGGAGCTC CGTAATTTAC ATGGTGCAGC TGCCAATCTT TGGCGTTATA
NL/24/01     ATAGGGGTCT ACGGGAGCTC CGTAATTTAC ATGGTGCAGC TGCCAATCTT TGGCGTTATA
NL/3/02      ATAGGGGTCT ACGGGAGCTC CGTAATTTAC ATGGTGCAGC TGCCAATCTT TGGCGTTATA
NL/3/98      ATAGGGGTCT ACGGAAGCTC CGTGATTTAC ATGGTTCAAT TGCCGATCTT TGGTGTCATA
NL/1/99      ATAGGGGTCT ACGGAAGCTC TGTGATTTAC ATGGTTCAAT TGCCGATCTT TGGTGTCATA
NL/2/99      ATAGGGGTCT ACGGAAGCTC TGTGATTTAC ATGGTTCAAT TGCCGATCTT TGGTGTCATA
NL/3/99      ATAGGGGTCT ACGGAAGCTC TGTGATTTAC ATGGTTCAAT TGCCGATCTT TGGTGTCATA
NL/11/00     ATAGGGGTCT ACGGAAGCTC TGTGATTTAC ATGGTTCAAT TGCCGATCTT TGGTGTCATA
NL/12/00     ATAGGGGTCT ACGGAAGCTC CGTGATTTAC ATGGTTCAAT TGCCGATCTT TGGTGTCATA
NL/1/01      ATAGGGGTCT ACGGAAGCTC TGTAATTTAC ATGGTTCAAT TGCCGATCTT TGGTGTCATA
NL/5/01      ATAGGGGTCT ACGGAAGCTC CGTGATTTAC ATGGTTCAAT TGCCGATCTT TGGTGTCATA
NL/9/01      ATAGGGGTCT ACGGAAGCTC CGTGATTTAC ATGGTTCAAT TGCCGATCTT TGGTGTCATA
NL/19/01     ATAGGGGTCT ACGGAAGCTC TGTGATTTAC ATGGTTCAAT TGCCGATCTT TGGTGTCATA
```

FIG.17A

| | |
|---|---|
| NL/21/01 | ATAGGGGTCT ACGGAAGCTC CGTGATTTAC ATGGTTCAAT TGCCGATCTT TGGTGTCATA |
| UK/11/01 | ATAGGGGTCT ACGGAAGCTC TGTGATTTAC ATGGTTCAAT TGCCGATCTT TGGGGTCATA |
| FL/1/01 | ATAGGGGTCT ACGGAAGCTC TGTGATTTAC ATGGTTCAAT TGCCGATCTT TGGTGTCATA |
| FL/2/01 | ATAGGGGTCT ACGGAAGCTC TGTGATTTAC ATGGTTCAAT TGCCGATCTT TGGTGTCATA |
| FL/5/01 | ATAGGGGTCT ACGGAAGCTC TGTGATTTAC ATGGTTCAAT TGCCGATCTT TGGTGTCATA |
| FL/7/01 | ATAGGGGTCT ACGGAAGCTC CGTGATTTAC ATGGTTCAAT TGCCGATCTT TGGTGTCATA |
| FL/9/01 | ATAGGGGTCT ACGGAAGCTC TGTGATTTAC ATGGTTCAAT TGCCGATCTT TGGTGTCATA |
| UK/10/01 | ATAGGGGTCT ACGGAAGCTC TGTGATTTAC ATGGTTCAAT TGCCGATCTT TGGTGTCATA |
| NL/1/02 | ATAGGGGTCT ACGGAAGCTC CGTGATTTAC ATGGTTCAAT TGCCGATCTT TGGTGTCATA |
| NL/1/94 | ATAGGGGTCT ACGGAAGCTC TGTGATTTAC ATGGTCCAGC TGCCGATCTT TGGTGTCATA |
| NL/1/96 | ATAGGGGTCT ACGGAAGCTC TGTGATTTAC ATGGTCCAGC TGCCGATCTT TGGTGTCATA |
| NL/6/97 | ATAGGGGTCT ACGGAAGCTC TGTGATTTAC ATGGTCCAGC TGCCGATCTT TGGTGTCATA |
| NL/7/00 | ATAGGGGTCT ACGGAAGCTC CGTGATTTAC ATGGTCCAGC TGCCGATCTT TGGTGTCATA |
| NL/9/00 | ATAGGGGTCT ACGGAAGCTC CGTGATTTAC ATGGTCCAGC TACCGATCTT TGGTGTCATA |
| NL/19/00 | ATAGGGGTCT ACGGAAGCTC CGTGATTTAC ATGGTCCAGC TGCCGATCTT TGGTGTCATA |
| NL/28/00 | ATAGGGGTCT ACGGAAGCTC CGTGATTTAC ATGGTCCAGC TGCCGATCTT TGGTGTCATA |
| NL/3/01 | ATAGGGGTCT ACGGAAGCTC CGTGATTTAC ATGGTCCAGC TGCCGATCTT TGGTGTCATA |
| NL/4/01 | ATAGGGGTCT ACGGAAGCTC CGTGATTTAC ATGGTCCAGC TGCCGATCTT TGGTGTCATA |
| NL/11/01 | ATAGGGGTCT ACGGAAGCTC CGTGATTTAC ATGGTCCAGC TGCCGATCTT TGGTGTCATA |
| NL/15/01 | ATAGGGGTCT ACGGAAGCTC CGTGATTTAC ATGGTCCAGC TGCCGATCTT TGGTGTCATA |
| NL/18/01 | ATAGGGGTCT ACGGAAGCTC CGTGATTTAC ATGGTCCAGC TGCCGATCTT TGGTGTCATA |
| FL/6/01 | ATAGGGGTCT ACGGAAGCTC CGTGATTTAC ATGGTCCAGC TGCCGATCTT TGGTGTCATA |
| UK/5/01 | ATAGGGGTCT ACGGAAGCTC TGTGATTTAC ATGGTCCAGC TGCCGATCTT TGGTGTCATA |
| UK/8/01 | ATAGGGGTCT ACGGAAGCTC TGTGATTTAC ATGGTCCAGC TGCCGATCTT TGGTGTCATA |
| NL/12/02 | ATAGGGGTCT ACGGAAGCTC CGTGATTTAC ATGGTCCAGC TGCCGATCTT tGGTGTCATA |
| HK/1/02 | ATAGGGGTCT ACGGAAGCTC CGTGATTTAC ATGGTCCAGC TGCCGATCTT TGGTGTCATA |

```
             ....|....| ....|....| ....|....| ....|....| ....|....| ....|....|
                  65         75         85         95        105        115
```

| | |
|---|---|
| NL/1/00 | GACACGCCTT GCTGGATAGT AAAAGCAGCC CCTTCTTGTT CAGGAAAAAA GGGAAACTAT |
| UK/1/00 | GACACGCCTT GCTGGATAGT AAAAGCAGCC CCTTCTTGCT CAGAAAAAAA GGGAAACTAT |
| NL/2/00 | GACACGCCTT GCTGGATAGT AAAAGCAGCC CCTTCTTGCT CAGAAAAAAA GGGAAACTAT |
| NL/13/00 | GACACGCCTT GCTGGATAGT AAAAGCAGCC CCTTCTTGCT CAGAAAAAAA GGGAAACTAT |
| NL/14/00 | GACACGCCTT GCTGGATAGT AAAAGCAGCC CCTTCTTGCT CAGAAAAAAA GGGAAACTAT |
| FL/3/01 | GACACGCCTT GCTGGATAGT AAAAGCAGCC CCTTCTTGTT CAGAAAAAAA GGGAAACTAT |
| FL/4/01 | GACACGCCTT GCTGGATAGT AAAAGCAGCC CCTTCTTGTT CAGAAAAAAA GGGAAACTAT |
| FL/8/01 | GACACGCCTT GCTGGATAGT AAAAGCAGCC CCTTCTTGCT CAGAAAAAAA GGGAAACTAT |
| UK/1/01 | GACACGCCTT GCTGGATAGT AAAAGCAGCC CCTTCTTGCT CAGAAAAAAA GGGAAACTAT |
| UK/7/01 | GACACGCCTT GCTGGATAGT AAAAGCAGCC CCTTCTTGCT CAGAAAAAAA GGGAAACTAT |
| FL/10/01 | GACACGCCTT GTTGGATAGT AAAAGCAGCC CCTTCTTGCT CAGAAAAAAA GGGAAACTAT |
| NL/6/01 | GACACGCCTT GCTGGATAGT AAAAGCGGCC CCTTCTTGCT CAGAAAAAAA GGGAAACTAT |
| NL/8/01 | GACACGCCTT GCTGGATAGT AAAAGCAGCC CCTTCTTGCT CAGAAAAAAA GGGAAACTAT |
| NL/10/01 | GACACGCCTT GCTGGATAGT AAAAGCGGCC CCTTCTTGCT CGGAAAAAAA GGGAAACTAT |
| NL/14/01 | GACACGCCTT GCTGGATAGT AAAAGCGGCC CCTTCTTGCT CAGAAAAAAA GGGAAACTAT |
| NL/20/01 | GACACGCCTT GCTGGATAGT AAAAGCGGCC CCTTCTTGCT CAGAAAAAAA GGGAAACTAT |
| NL/25/01 | GACACGCCTT GCTGGATAGT AAAAGCGGCC CCTTCTTGCT CAGAAAAAAA GGGAAACTAT |
| NL/26/01 | GACACGCCTT GCTGGATAGT AAAAGCGGCC CCTTCTTGCT CAGAAAAAAA GGGAAACTAT |
| NL/28/01 | GACACGCCTT GCTGGATAGT AAAAGCGGCC CCTTCTTGCT CAGAAAAAAA GGGAAACTAT |
| NL/30/01 | GACACGCCTT GCTGGATAGT AAAAGCGGCC CCTTCTTGCT CAGAAAAAAA GGGAAACTAT |
| BR/2/01 | GACACGCCTT GCTGGATAGT AAAAGCAGCC CCTTCTTGTT CAGGAAAAAA GGGAAACTAT |
| BR/3/01 | GACACGCCTT GCTGGATAGT AAAAGCAGCC CCTTCTTGTT CAGGAAAAAA GGGAAACTAT |
| NL/2/02 | GACACGCCTT GCTGGATAGT AAAAGCGGCC CCTTCTTGCT CAGAAAAAAA GGGAAACTAT |
| NL/4/02 | GACACGCCTT GCTGGATAGT AAAAGCAGCC CCTTCTTGCT CAGAAAAAAA GGGAAACTAT |
| NL/5/02 | GACACGCCTT GCTGGATAGT AAAAGCGGCC CCTTCTTGCT CAGAAAAAAA GGGAAACTAT |
| NL/6/02 | GACACGCCTT GCTGGATAGT AAAAGCGGCC CCTTCTTGCT CAGAAAAAAA GGGAAACTAT |
| NL/7/02 | GACACGCCTT GCTGGATAGT AAAAGCAGCC CCTTCTTGTT CAGGAAAAAA GGGAAACTAT |
| NL/9/02 | GACACGCCTT GCTGGATAGT AAAAGCGGCC CCTTCTTGCT CAGAAAAAAA GGGAAACTAT |
| FL/1/02 | GACACGCCTT GCTGGATAGT AAAAGCAGCC CCTTCTTGTT CAGGAAAAAA GGGAAACTAT |
| NL/1/81 | GACACGCCTT GCTGGATAGT AAAAGCAGCC CCCTCTTGTT CCGAAAAAAA GGGAAACTAT |
| NL/1/93 | GACACGCCTT GCTGGATAGT AAAAGCAGCC CCCTCTTGTT CCGAAAAAAA GGGAAACTAT |
| NL/2/93 | GACACGCCTT GCTGGATAGT AAAAGCAGCC CCCTCTTGTT CCGAAAAAAA GGGAAACTAT |

FIG.17B

| | | | | | | |
|---|---|---|---|---|---|---|
| NL/4/93 | GACACGCCTT | GCTGGATAGT | AAAAGCAGCC | CCCTCTTGTT | CCGAAAAAAA | GGGAAACTAT |
| NL/1/95 | GACACGCCCT | GCTGGATAGT | AAAAGCAGCC | CCCTCTTGTT | CCGAAAAAAA | GGGAAACTAT |
| NL/2/96 | GACACGCCTT | GCTGGATAGT | AAAAGCAGCC | CCCTCTTGTT | CCGAAAAAAA | GGGAAACTAT |
| NL/3/96 | GACACGCCCT | GCTGGATAGT | AAAAGCAGCC | CCCTCTTGTT | CCGAAAAAAA | GGGAAACTAT |
| NL/1/98 | GACACGCCTT | GCTGGATAGT | AAAAGCAGCC | CCTTCTTGTT | CCGAAAAAAA | GGGAAACTAT |
| NL/17/00 | GACACGCCTT | GCTGGATAGT | AAAAGCAGCC | CCTTCTTGTT | CCGAAAAAAA | GGGAAACTAT |
| NL/22/01 | GACACGCCTT | GCTGGATAGT | AAAAGCAGCC | CCTTCTTGTT | CCGAAAAAAA | GGGAAACTAT |
| NL/29/01 | GACACGCCTT | GCTGGATAGT | AAAAGCAGCC | CCTTCTTGTT | CCGAAAAAAA | GGGAAACTAT |
| NL/23/01 | GACACGCCTT | GCTGGATAGT | AAAAGCAGCC | CCTTCTTGTT | CCGAAAAAAA | GGGAAACTAT |
| NL/17/01 | GACACACCTT | GCTGGATAGT | AAAAGCAGCC | CCTTCTTGTT | CCGAAAAAAA | GGGAAATTAT |
| NL/24/01 | GACACGCCTT | GCTGGATAGT | AAAAGCAGCC | CCTTCTTGTT | CCGAAAAAAA | GGGAAACTAT |
| NL/3/02 | GACACGCCTT | GCTGGATAGT | AAAAGCAGCC | CCTTCTTGTT | CCGAAAAAAA | GGGAAACTAT |
| NL/3/98 | GATACACCTT | GTTGGATAAT | CAAGGCAGCT | CCCTCTTGCT | CAGAAAAAAA | CGGGAATTAT |
| NL/1/99 | GATACACCTT | GTTGGATCAT | CAAGGCAGCT | CCCTCTTGCT | CAGAAAAAAA | CGGGAATTAT |
| NL/2/99 | GATACACCTT | GTTGGATCAT | CAAGGCAGCT | CCCTCTTGCT | CAGAAAAAAA | CGGGAATTAT |
| NL/3/99 | GATACACCTT | GTTGGATCAT | CAAGGCAGCT | CCCTCTTGCT | CAGAAAAAAA | CGGGAATTAT |
| NL/11/00 | GATACACCTT | GTTGGATAAT | CAAGGCAGCT | CCCTCTTGCT | CAGAAAAAAA | CGGGAATTAT |
| NL/12/00 | GATACACCTT | GTTGGATAAT | CAAGGCAGCT | CCCTCTTGCT | CAGAAAAAAA | CGGGAATTAT |
| NL/1/01 | GATACACCTT | GTTGGATAAT | CAAGGCAGCT | CCCTCTTGCT | CAGAAAAAAA | CGGGAATTAT |
| NL/5/01 | GATACACCTT | GTTGGATAAT | CAAGGCAGCT | CCCTCTTGCT | CAGAAAAAAA | CGGGAATTAT |
| NL/9/01 | GATACACCTT | GTTGGATAAT | CAAGGCAGCT | CCCTCTTGCT | CAGAAAAAAA | CGGGAATTAT |
| NL/19/01 | GATACACCTT | GTTGGATAAT | CAAGGCAGCT | CCCTCTTGCT | CAGAAAAAAA | CGGGAATTAT |
| NL/21/01 | GATACACCTT | GTTGGATAAT | CAAGGCAGCT | CCCTCTTGCT | CAGAAAAAAA | CGGGAATTAT |
| UK/11/01 | GATACACCTT | GTTGGATAAT | CAAGGCAGCT | CCCTCTTGCT | CAGAAAAAAA | CGGGAATTAT |
| FL/1/01 | GATACACCTT | GTTGGATAAT | CAAGGCAGCC | CCCTCTTGCT | CAGAGAAAAA | CGGGAATTAT |
| FL/2/01 | GATACACCTT | GTTGGATAAT | CAAGGCAGCT | CCCTCTTGCT | CAGAGAAAAA | CGGGAATTAT |
| FL/5/01 | GATACACCTT | GTTGGATAAT | CAAGGCAGCT | CCCTCTTGCT | CAGAAAAAAA | CGGGAATTAT |
| FL/7/01 | GATACACCTT | GTTGGATAAT | CAAGGCAGCT | CCCTCTTGCT | CAGAAAAAAA | CGGGAATTAT |
| FL/9/01 | GATACACCTT | GTTGGATAAT | CAAGGCAGCT | CCCTCTTGCT | CAGAGAAAAA | CGGGAATTAT |
| UK/10/01 | GATACACCTT | GTTGGATAAT | CAAGGCAGCT | CCCTCTTGCT | CAGAAAAAAA | CGGGAATTAT |
| NL/1/02 | GATACACCTT | GTTGGATAAT | CAAGGCAGCT | CCCTCTTGCT | CAGAAAAAAA | CGGGAATTAT |
| NL/1/94 | GATACACCTT | GTTGGATAAT | CAAGGCAGCT | CCCTCTTGTT | CAGAAAAAGA | TGGAAATTAT |
| NL/1/96 | GATACACCTT | GTTGGATAAT | CAAGGCAGCT | CCCTCTTGTT | CAGAAAAAGA | TGGAAATTAT |
| NL/6/97 | GATACACCTT | GTTGGATAAT | CAAGGCAGCT | CCCTCTTGTT | CAGAAAAAGA | TGGAAATTAT |
| NL/7/00 | GATACACCTT | GTTGGATAAT | CAAGGCAGCT | CCCTCTTGTT | CAGAAAAAGA | TGGAAATTAT |
| NL/9/00 | GATACACCTT | GTTGGATAAT | CAAGGCAGCT | CCCTCTTGTT | CAGAAAAAGA | TGGAAATTAT |
| NL/19/00 | GATACACCTT | GTTGGATAAT | CAAGGCAGCT | CCCTCTTGTT | CAGAAAAAGA | TGGAAATTAT |
| NL/28/00 | GATACACCTT | GTTGGATAAT | CAAGGCAGCT | CCCTCTTGTT | CAGAAAAAGA | TGGAAATTAT |
| NL/3/01 | GATACACCTT | GTTGGATAAT | CAAGGCAGCT | CCCTCTTGTT | CAGAAAAAGA | TGGAAATTAT |
| NL/4/01 | GATACACCTT | GTTGGATAAT | CAAGGCAGCT | CCCTCTTGTT | CAGAAAAAGA | TGGAAATTAT |
| NL/11/01 | GATACACCTT | GTTGGATAAT | CAAGGCAGCT | CCCTCTTGTT | CAGAAAAAGA | TGGAAATTAT |
| NL/15/01 | GATACACCTT | GTTGGATAAT | CAAGGCAGCT | CCCTCTTGTT | CAGAAAAAGA | TGGAAATTAT |
| NL/18/01 | GATACACCTT | GTTGGATAAT | CAAGGCAGCT | CCCTCTTGTT | CAGAAAAAGA | TGGAAATTAT |
| FL/6/01 | GATACACCTT | GTTGGATAAT | CAAGGCAGCT | CCCTCTTGTT | CAGAAAAAGA | TGGAAATTAT |
| UK/5/01 | GATACACCTT | GTTGGATAAT | CAAGGCAGCT | CCCTCTTGTT | CAGAAAAAGA | TGGAAATTAT |
| UK/8/01 | GATACACCTT | GTTGGATAAT | CAAGGCAGCT | CCCTCTTGTT | CAGAAAAAGA | TGGAAATTAT |
| NL/12/02 | GATACACCTT | GTTGGATAAT | CAAGGCAGCT | CCCTCTTGTT | CAGAAAAAGA | TGGAAATTAT |
| HK/1/02 | GATACACCTT | GTTGGATAAT | CAAGGCAGCT | CCCTCTTGTT | CAGAAAAAGA | TGGAAATTAT |

```
         ....|....| ....|....| ....|....| ....|....| ....|....| ....|....|
             125        135        145        155        165        175
```

| | | | | | | |
|---|---|---|---|---|---|---|
| NL/1/00 | GCTTGCCTCT | TAAGAGAAGA | CCAAGGATGG | TATTGTCAAA | ATGCAGGGTC | AACTGTTTAC |
| UK/1/00 | GCTTGCCTCT | TAAGAGAAGA | TCAAGGATGG | TATTGTCAGA | ATGCAGGGTC | AACTGTTTAC |
| NL/2/00 | GCTTGCCTCT | TAAGAGAAGA | TCAAGGATGG | TATTGTCAGA | ATGCAGGGTC | AACTGTTTAC |
| NL/13/00 | GCTTGCCTCT | TAAGAGAAGA | TCAAGGATGG | TATTGTCAGA | ATGCAGGGTC | AACTGTTTAC |
| NL/14/00 | GCTTGCCTCT | TAAGAGAAGA | TCAAGGATGG | TATTGTCAGA | ATGCAGGGTC | AACTGTTTAC |
| FL/3/01 | GCTTGCCTCT | TAAGAGAAGA | CCAAGGATGG | TATTGTCAGA | ATGCAGGGTC | AACTGTTTAC |
| FL/4/01 | GCTTGCCTCT | TAAGAGAAGA | CCAAGGATGG | TATTGTCAGA | ATGCAGGGTC | AACTGTTTAC |
| FL/8/01 | GCTTGCCTCT | TAAGAGAAGA | CCAAGGATGG | TATTGTCAGA | ATGCAGGGTC | AACTGTTTAC |
| UK/1/01 | GCTTGCCTCT | TAAGAGAAGA | TCAGGGATGG | TATTGTCAGA | ATGCAGGGTC | AACTGTTTAC |
| UK/7/01 | GCTTGCCTCT | TAAGAGAAGA | TCAAGGATGG | TATTGTCAGA | ATGCAGGGTC | AACTGTTTAC |

FIG.17C

| | | | | | | |
|---|---|---|---|---|---|---|
| FL/10/01 | GCTTGCCTCT | TAAGAGAAGA | TCAAGGATGG | TATTGTCAGA | ATGCAGGGTC | AACTGTTTAC |
| NL/6/01 | GCTTGCCTCT | TAAGAGAAGA | TCAAGGATGG | TATTGTCAGA | ATGCAGGGTC | AACTGTTTAC |
| NL/8/01 | GCTTGCCTTT | TAAGAGAAGA | TCAAGGATGG | TATTGTCAGA | ATGCAGGGTC | AACTGTTTAC |
| NL/10/01 | GCTTGCCTCT | TAAGAGAAGA | TCAAAGATGG | TATTGTCAGA | ATGCAGGGTC | AACTGTTTAC |
| NL/14/01 | GCTTGCCTCT | TAAGAGAAGA | TCAAGGATGG | TATTGTCAGA | ATGCAGGGTC | AACTGTTTAC |
| NL/20/01 | GCTTGCCTCT | TAAGAGAAGA | TCAAGGATGG | TATTGTCAGA | ATGCAGGGTC | AACTGTTTAC |
| NL/25/01 | GCTTGCCTCT | TAAGAGAAGA | TCAAGGATGG | TATTGTCAGA | ATGCAGGGTC | AACTGTTTAC |
| NL/26/01 | GCTTGCCTCT | TAAGAGAAGA | TCAAGGATGG | TATTGTCAGA | ATGCAGGGTC | AACTGTTTAC |
| NL/28/01 | GCTTGCCTCT | TAAGAGAAGA | TCAAGGATGG | TATTGTCAGA | ATGCAGGGTC | AACTGTTTAC |
| NL/30/01 | GCTTGCCTCT | TAAGAGAAGA | TCAAGGATGG | TATTGTCAGA | ATGCAGGGTC | AACTGTTTAC |
| BR/2/01 | GCTTGCCTCT | TAAGAGAAGA | CCAAGGATGG | TATTGTCAAA | ATGCAGGGTC | AACTGTTTAC |
| BR/3/01 | GCTTGCCTCT | TAAGAGAAGA | CCAAGGATGG | TATTGTCAAA | ATGCAGGGTC | AACTGTTTAC |
| NL/2/02 | GCTTGCCTCT | TAAGAGAAGA | TCAAGGATGG | TATTGTCAGA | ATGCAGGGTC | AACTGTTTAC |
| NL/4/02 | GCTTGCCTCT | TAAGAGAAGA | TCAAGGATGG | TATTGTCAGA | ATGCAGGGTC | AACTGTTTAC |
| NL/5/02 | GCTTGCCTCT | TAAGAGAAGA | TCAAGGATGG | TATTGTCAGA | ATGCAGGGTC | AACTGTTTAC |
| NL/6/02 | GCTTGCCTCT | TAAGAGAAGA | TCAAGGATGG | TATTGTCAGA | ATGCAGGGTC | AACTGTTTAC |
| NL/7/02 | GCTTGCCTCT | TAAGAGAAGA | CCAAGGATGG | TATTGTCAAA | ATGCAGGGTC | AACTGTTTAC |
| NL/9/02 | GCTTGCCTCT | TAAGAGAAGA | TCAAGGATGG | TATTGTCAGA | ATGCAGGGTC | AACTGTTTAC |
| FL/1/02 | GCTTGCCTCT | TAAGAGAAGA | CCAAGGATGG | TATTGTCAAA | ATGCAGGGTC | AACTGTTTAC |
| NL/1/81 | GCTTGCCTCT | TAAGAGAAGA | CCAAGGGTGG | TATTGTCAGA | ATGCAGGGTC | AACTGTTTAC |
| NL/1/93 | GCTTGCCTTT | TAAGAGAAGA | TCAAGGGTGG | TATTGTCAGA | ATGCAGGGTC | AACTGTTTAC |
| NL/2/93 | GCTTGCCTTT | TAAGAGAAGA | TCAAGGGTGG | TATTGTCAGA | ATGCAGGGTC | AACTGTTTAC |
| NL/4/93 | GCTTGCCTTT | TAAGAGAAGA | TCAAGGGTGG | TATTGTCAGA | ATGCAGGGTC | AACTGTTTAC |
| NL/1/95 | GCTTGCCTTC | TAAGAGAAGA | CCAAGGGTGG | TATTGTCAGA | ATGCAGGGTC | AACTGTTTAC |
| NL/2/96 | GCTTGCCTCT | TAAGAGAAGA | CCAAGGGTGG | TATTGTCAGA | ATGCAGGGTC | AACTGTTTAC |
| NL/3/96 | GCTTGCCTTC | TAAGAGAAGA | CCAAGGGTGG | TATTGTCAGA | ATGCAGGGTC | AACTGTTTAC |
| NL/1/98 | GCTTGCCTCT | TAAGAGAAGA | CCAAGGGTGG | TATTGTCAGA | ATGCAGGGTC | AACTGTTTAC |
| NL/17/00 | GCTTGCCTCT | TAAGAGAAGA | CCAAGGGTGG | TATTGTCAGA | ATGCAGGGTC | AACTGTTTAC |
| NL/22/01 | GCTTGCCTCT | TAAGAGAAGA | CCAAGGATGG | TATTGTCAGA | ATGCAGGGTC | AACTGTTTAC |
| NL/29/01 | GCTTGCCTCT | TAAGAGAAGA | CCAAGGGTGG | TATTGTCAGA | ATGCAGGGTC | AACTGTTTAC |
| NL/23/01 | GCTTGCCTCT | TAAGAGAAGA | CCAAGGATGG | TATTGTCAGA | ATGCAGGGTC | AACTGTTTAC |
| NL/17/01 | GCTTGCCTCT | TAAGAGAAGA | CCAAGGGTGG | TATTGTCAGA | ATGCAGGGTC | AACTGTTTAC |
| NL/24/01 | GCTTGCCTCT | TAAGAGAAGA | CCAAGGATGG | TATTGTCAGA | ATGCAGGGTC | AACTGTTTAC |
| NL/3/02 | GCTTGCCTCT | TAAGAGAAGA | CCAAGGGTGG | TATTGTCAGA | ATGCAGGGTC | AACTGTTTAC |
| NL/3/98 | GCTTGCCTCC | TAAGAGAGGA | TCAAGGGTGG | TATTGTAAAA | ATGCAGGATC | CACTGTTTAC |
| NL/1/99 | GCTTGCCTCC | TAAGAGAGGA | TCAAGGGTGG | TATTGTAAAA | ATGCAGGATC | TACTGTTTAC |
| NL/2/99 | GCTTGCCTCC | TAAGAGAGGA | TCAAGGGTGG | TATTGTAAAA | ATGCAGGATC | TACTGTTTAC |
| NL/3/99 | GCTTGCCTCC | TAAGAGAGGA | TCAAGGGTGG | TATTGTAAAA | ATGCAGGATC | TACTGTTTAC |
| NL/11/00 | GCTTGCCTCC | TAAGAGAGGA | TCAAGGGTGG | TATTGCAAAA | ATGCAGGATC | CACTGTTTAC |
| NL/12/00 | GCTTGCCTCC | TAAGAGAGGA | TCAAGGGTGG | TATTGTAAAA | ATGCAGGATC | CACTGTTTAC |
| NL/1/01 | GCTTGCCTCC | TAAGAGAGGA | TCAAGGGTGG | TATTGTAAAA | ATGCAGGATC | CACTGTTTAC |
| NL/5/01 | GCTTGCCTCC | TAAGAGAGGA | TCAAGGGTGG | TATTGTAAAA | ATGCAGGATC | CACTGTTTAC |
| NL/9/01 | GCTTGCCTCC | TAAGAGAGGA | TCAAGGGTGG | TATTGTAAAA | ATGCAGGATC | CACTGTTTAC |
| NL/19/01 | GCTTGCCTCC | TAAGAGAGGA | TCAAGGGTGG | TATTGTAAAA | ATGCAGGATC | CACTGTTTAC |
| NL/21/01 | GCTTGCCTCC | TAAGAGAGGA | TCAAGGGTGG | TACTGTAAAA | ATGCAGGATC | CACTGTTTAC |
| UK/11/01 | GCTTGCCTCC | TAAGAGAGGA | TCAAGGGTGG | TATTGTAAAA | ATGCAGGATC | CACTGTTTAC |
| FL/1/01 | GCTTGCCTCC | TAAGAGAGGA | TCAAGGGTGG | TATTGTAAAA | ATGCAGGATC | CACTGTTTAC |
| FL/2/01 | GCTTGCCTCC | TAAGAGAGGA | TCAAGGGTGG | TATTGTAAAA | ATGCAGGATC | CACTGTTTAC |
| FL/5/01 | GCTTGCCTCC | TAAGAGAGGA | TCAAGGGTGG | TATTGTAAAA | ATGCAGGATC | CACTGTTTAC |
| FL/7/01 | GCTTGCCTCC | TAAGAGAGGA | TCAAGGGTGG | TATTGTAAAA | ATGCAGGATC | CACTGTTTAC |
| FL/9/01 | GCTTGCCTCC | TAAGAGAGGA | TCAAGGGTGG | TATTGTAAAA | ATGCAGGATC | CACTGTTTAC |
| UK/10/01 | GCTTGCCTCC | TAAGAGAGGA | TCAAGGGTGG | TATTGTAAAA | ATGCAGGATC | CACTGTTTAC |
| NL/1/02 | GCTTGCCTCC | TAAGAGAGGA | TCAAGGGTGG | TACTGTAAAA | ATGCAGGATC | CACTGTTTAC |
| NL/1/94 | GCTTGCCTCC | TAAGAGAGGA | TCAAGGGTGG | TATTGCAAAA | ATGCAGGATC | CACTGTTTAC |
| NL/1/96 | GCTTGCCTCC | TAAGAGAGGA | TCAAGGGTGG | TATTGTAAAA | ATGCAGGATC | CACTGTTTAC |
| NL/6/97 | GCTTGCCTCC | TAAGAGAGGA | TCAAGGGTGG | TATTGTAAAA | ATGCAGGATC | CACTGTTTAC |
| NL/7/00 | GCTTGCCTCC | TAAGAGAGGA | CCAAGGGTGG | TATTGTAAAA | ATGCGGGATC | CACTGTTTAC |
| NL/9/00 | GCTTGCCTCC | TAAGAGAGGA | TCAAGGGTGG | TATTGTAAAA | ATGCAGGATC | CACTGTTTAC |
| NL/19/00 | GCTTGCCTCC | TAAGAGAGGA | TCAAGGGTGG | TATTGTAAAA | ATGCAGGATC | CACTGTTTAC |
| NL/28/00 | GCTTGCCTCC | TAAGAGAGGA | TCAAGGGTGG | TATTGTAAAA | ATGCAGGATC | CACTGTTTAC |
| NL/3/01 | GCTTGCCTCC | TAAGAGAGGA | CCAAGGGTGG | TATTGTAAAA | ATGCGGGATC | CACTGTTTAC |

FIG. 17D

```
NL/4/01    GCTTGCCTCC TAAGAGAGGA TCAAGGGTGG TATTGTAAAA ATGCAGGATC CACTGTTTAC
NL/11/01   GCTTGCCTCC TAAGAGAGGA TCAAGGGTGG TATTGTAAAA ATGCAGGATC CACTGTTTAC
NL/15/01   GCTTGCCTCC TAAGAGAGGA TCAAGGGTGG TATTGTAAAA ATGCAGGATC CACTGTTTAC
NL/18/01   GCTTGCCTCC TAAGAGAGGA TCAAGGGTGG TATTGTAAAA ATGCAGGATC CACTGTTTAC
FL/6/01    GCTTGCCTCC TAAGAGAGGA TCAAGGGTGG TATTGTAAAA ATGCAGGATC CACTGTTTAC
UK/5/01    GCTTGCCTCC TAAGAGAGGA TCAAGGGTGG TATTGTAAAA ATGCAGGATC CACTGTTTAC
UK/8/01    GCTTGCCTCC TAAGAGAGGA TCAAGGGTGG TATTGTAAAA ATGCAGGATC CACTGTTTAC
NL/12/02   GCTTGCCTCC TAAGAGAGGA TCAAGGGTGG TATTGTAAAA ATGCAGGATC CACTGTTTAC
HK/1/02    GCTTGCCTCC TAAGAGAGGA TCAAGGGTGG TATTGTAAAA ATGCAGGATC CACTGTTTAC

....|....| ....|....| ....|....| ....|....| ....|....| ....|....|
               185        195        205        215        225        235
NL/1/00    TACCCAAATG AAAAAGACTG TGAAACAAGA GGAGACCATG TCTTTTGCGA CACAGCAGCA
UK/1/00    TACCCAAATG AAAAAGACTG CGAAACAAGA GGAGACCATG TCTTTTGCGA CACAGCAGCA
NL/2/00    TACCCAAATG AAAAAGATTG CGAAACAAGA GGAGACCATG TCTTTTGCGA CACAGCAGCA
NL/13/00   TACCCAAATG AAAAAGACTG CGAAACAAGA GGAGACCATG TCTTTTGCGA CACAGCAGCA
NL/14/00   TACCCAAATG AAAAAGATTG CGAAACAAGA GGAGACCATG TCTTTTGCGA CACAGCAGCA
FL/3/01    TACCCAAATG AAAAAGACTG TGAAACAAGA GGAGACCATG TCTTTTGCGA CACAGCAGCA
FL/4/01    TACCCAAATG AAAAAGACTG TGAAACAAGA GGAGACCATG TCTTTTGCGA CACAGCAGCA
FL/8/01    TACCCAAATG AAAAAGACTG TGAAACAAGA GGAGACCATG TCTTTTGCGA CACAGCAGCA
UK/1/01    TACCCAAATG AAAAAGACTG TGAAACAAGA GGAGACCATG TCTTTTGCGA CACAGCAGCA
UK/7/01    TACCCAAATG AAAAAGACTG CGAAACAAGA GGAGACCATG TCTTTTGCGA CACAGCAGCA
FL/10/01   TACCCAAATG AAAAAGACTG CGAAACAAGA GGAGACCATG TCTTTTGCGA CACAGCAGCA
NL/6/01    TACCCAAATG AAAAAGACTG CGAAACAAGA GGAGACCATG TCTTTTGCGA CACAGCAGCA
NL/8/01    TACCCAAATG AAAAAGACTG CGAAACAAGA GGAGACCATG TCTTTTGCGA CACAGCAGCA
NL/10/01   TACCCAAATG AAAAAGACTG CGAAACAAGA GGAGACCATG TCTTTTGCGA CACAGCAGCA
NL/14/01   TACCCAAATG AAAAAGACTG CGAAACAAGA GGAGACCATG TCTTTTGCGA CACAGCAGCA
NL/20/01   TACCCAAATG AAAAAGACTG CGAAACAAGA GGAGACCATG TCTTTTGCGA CACAGCAGCA
NL/25/01   TACCCAAATG AAAAAGACTG CGAAACAAGA GGAGACCATG TCTTTTGCGA CACAGCAGCA
NL/26/01   TACCCAAATG AAAAAGACTG CGAAACAAGA GGAGACCATG TCTTTTGCGA CACAGCAGCA
NL/28/01   TACCCAAATG AAAAAGACTG CGAAACAAGA GGAGACCATG TCTTTTGCGA CACAGCAGCA
NL/30/01   TACCCAAATG AAAAAGACTG CGAAACAAGA GGAGACCATG TCTTTTGCGA CACAGCAGCA
BR/2/01    TACCCAAATG AAAAAGACTG TGAAACAAGA GGAGACCATG TCTTTTGCGA CACAGCAGCA
BR/3/01    TACCCAAATG AAAAAGACTG TGAAACAAGA GGAGACCATG TCTTTTGCGA CACAGCAGCA
NL/2/02    TACCCAAATG AAAAAGACTG CGAAACAAGA GGAGACCATG TCTTTTGCGA CACAGCAGCA
NL/4/02    TACCCAAATG AAAAAGACTG CGAAACAAGA GGAGACCATG TCTTTTGCGA CACAGCAGCA
NL/5/02    TACCCAAATG AAAAAGACTG CGAAACAAGA GGAGACCATG TCTTTTGCGA CACAGCAGCA
NL/6/02    TACCCAAATG AAAAAGACTG CGAAACAAGA GGAGACCATG TCTTTTGCGA CACAGCAGCA
NL/7/02    TACCCAAATG AAAAAGACTG TGAAACAAGA GGAGACCATG TCTTTTGCGA CACAGCAGCA
NL/9/02    TACCCAAATG AAAAAGACTG CGAAACAAGA GGAGACCATG TCTTTTGCGA CACAGCAGCA
FL/1/02    TACCCAAATG AAAAAGACTG TGAAACAAGA GGAGACCATG TCTTTTGCGA CACAGCAGCA
NL/1/81    TACCCAAATG AGAAAGACTG TGAAACAAGA GGAGACCATG TCTTTTGCGA CACAGCAGCA
NL/1/93    TACCCAAATG AGAAAGACTG TGAAACAAGA GGAGACCATG TCTTTTGCGA CACAGCAGCA
NL/2/93    TACCCAAATG AGAAAGACTG TGAAACAAGA GGAGACCATG TCTTTTGCGA CACAGTAGCA
NL/4/93    TACCCAAATG AGAAAGACTG TGAAACAAGA GGAGACCATG TCTTTTGCGA CACAGCAGCA
NL/1/95    TACCCAAATG AGAAGGACTG TGAAACAAGA GGAGACCATG TCTTTTGCGA CACAGCAGCA
NL/2/96    TACCCAAATG AGAAAGACTG TGAAACAAGA GGAGACCATG TCTTTTGCGA CACAGCAGCA
NL/3/96    TACCCAAATG AGAAGGACTG TGAAACAAGA GGAGACCATG TCTTTTGCGA CACAGCAGCA
NL/1/98    TACCCAAATG AGAAAGACTG TGAAACAAGA GGAGACCATG TCTTTTGCGA CACAGCAGCA
NL/17/00   TACCCAAATG AGAAAGACTG TGAAACAAGA GGAGACCATG TCTTTTGCGA CACAGCAGCA
NL/22/01   TACCCAAATG AGAAAGACTG TGAAACAAGA GGAGACCATG TCTTTTGCGA CACAGCAGCA
NL/29/01   TACCCAAATG AGAAAGACTG TGAAACAAGA GGAGACCATG TCTTTTGCGA CACAGCAGCA
NL/23/01   TACCCAAATG AGAAAGACTG TGAAACAAGA GGAGACCATG TCTTTTGCGA CACAGCAGCA
NL/17/01   TACCCAAATG AGAAAGACTG TGAAACAAGA GGAGACCATG TCTTTTGCGA CACAGCAGCA
NL/24/01   TACCCAAATG AGAAAGACTG TGAAACAAGA GGAGACCATG TCTTTTGCGA CACAGCAGCA
NL/3/02    TACCCAAATG AGAAAGACTG TGAAACAAGA GGAGACCATG TCTTTTGCGA CACAGCAGCA
NL/3/98    TACCCAAATG AAAAAGACTG CGAAACAAGA GGTGATCATG TTTTTTGTGA CACAGCAGCA
NL/1/99    TACCCAAATG AAAAAGACTG CGAAACAAGA GGTGATCATG TTTTTTGTGA CACAGCAGCA
NL/2/99    TACCCAAATG AAAAAGACTG CGAAACAAGA GGTGATCATG TTTTTTGTGA CACAGCAGCA
NL/3/99    TACCCAAATG AAAAAGACTG CGAAACAAGA GGTGATCATG TTTTTTGTGA CACAGCAGCA
NL/11/00   TACCCAAATG AAAAAGACTG CGAAACAAGA GGTGATCATG TTTTTTGTGA CACAGCAGCA
```

FIG.17E

```
NL/12/00    TACCCAAATG AAAAAGACTG CGAAACAAGA GGTGATCATG TTTTTTGTGA CACAGCAGCA
NL/1/01     TACCCAAATG AAAAAGACTG CGAAACAAGA GGTGATCATG TTTTTTGTGA CACAGCAGCA
NL/5/01     TACCCAAATG AAAAAGACTG CGAAACAAGA GGTGATCATG TTTTTTGTGA CACAGCAGCA
NL/9/01     TACCCAAATG AAAAAGACTG CGAAACAAGA GGTGATCATG TTTTTTGTGA CACAGCAGCA
NL/19/01    TACCCAAATG AAAAAGACTG TGAAACAAGA GGTGATCATG TTTTTTGTGA CACAGCAGCA
NL/21/01    TACCCAAATG AAAAAGACTG CGAAACAAGA GGTGATCATG TTTTTTGTGA CACAGCAGCA
UK/11/01    TACCCAAATG AAAAAGACTG CGAAACAAGA GGTGATCATG TTTTTTGTGA TACAGCAGCA
FL/1/01     TACCCAAATG AAAAAGACTG CGAAACAAGA GGTGATCATG TGTTTTGTGA CACAGCAGCA
FL/2/01     TACCCAAATG AAAAAGACTG CGAAACAAGA GGTGATCATG TGTTTTGTGA CACAGCAGCA
FL/5/01     TACCCAAATG AAAAAGACTG TGAAACAAGA GGTGATCATG TTTTTTGTGA CACAGCAGCA
FL/7/01     TACCCAAATG AAAAAGACTG CGAAACAAGA GGTGATCATG TTTTTTGTGA CACAGCAGCA
FL/9/01     TACCCAAATG AAAAAGACTG CGAAACAAGA GGTGATCATG TGTTTTGTGA CACAGCAGCA
UK/10/01    TACCCAAATG AAAAAGACTG CGAAACAAGA GGTGATCATG TTTTTTGTGA TACAGCAGCA
NL/1/02     TACCCAAATG AAAAAGACTG CGAAACAAGA GGTGATCATG TTTTTTGTGA CACAGCAGCA
NL/1/94     TACCCAAATG AAAAAGACTG CGAAACAAGA GGTGATCATG TTTTTTGTGA CACAGCAGCA
NL/1/96     TACCCAAATG AAAAAGACTG CGAAACAAGA GGTGATCATG TTTTTTGTGA CACAGCAGCA
NL/6/97     TACCCAAATG AAAAAGACTG CGAAACAAGA GGTGATCATG TTTTTTGTGA CACAGCAGCA
NL/7/00     TACCCAAATG AAAAAGACTG CGAAACAAGA GGTGATCATG TTTTTTGTGA CACAGCAGCA
NL/9/00     TACCCAAATG AAAAAGACTG CGAAACAAGA GGTGATCATG TTTTTTGTGA CACAGCTGCA
NL/19/00    TACCCAAATG AAAAAGACTG CGAAACAAGA GGTGATCATG TTTTTTGTGA CACAGCAGCA
NL/28/00    TACCCAAATG AAAAAGACTG TGAAACAAGA GGTGATCATG TTTTTTGTGA CACAGCAGCA
NL/3/01     TACCCAAATG AAAAAGACTG CGAAACAAGA GGTGATCATG TTTTTTGTGA CACAGCAGCA
NL/4/01     TACCCAAATG AAAAAGACTG CGAAACAAGA GGTGATCATG TTTTTTGTGA CACAGCAGCA
NL/11/01    TACCCAAATG AAAAAGACTG TGAAACAAGA GGTGATCATG TTTTTTGTGA CACAGCAGCA
NL/15/01    TACCCAAATG AAAAAGACTG CGAAACAAGA GGTGATCATG TTTTTTGTGA CACAGCTGCA
NL/18/01    TACCCAAATG AAAAAGACTG CGAAACAAGA GGTGATCATG TTTTTTGTGA CACAGCTGCA
FL/6/01     TACCCAAATG AAAAAGACTG CGAAACAAGA GGTGATCATG TTTTTTGTGA CACAGCTGCA
UK/5/01     TACCCAAATG AAAAAGACTG CGAAACAAGA GGTGATCATG TTTTTTGTGA CACAGCTGCA
UK/8/01     TACCCAAATG AAAAAGACTG CGAAACAAGA GGTGATCATG TTTTTTGTGA CACAGCAGCA
NL/12/02    TACCCAAATG AAAAAGACTG CGAAACAAGA GGTGATCATG TTTTTTGTGA CACAGCTGCA
HK/1/02     TACCCAAATG AAAAAGACTG CGAAACAAGA GGTGATCATG TTTTTTGTGA CACAGCAGCA

....|....| ....|....| ....|....| ....|....| ....|....| ....|....|
               245        255        265        275        285        295
NL/1/00     GGAATCAATG TTGCTGAGCA GTCAAAGGAG TGCAACATAA ACATATCTAC TACTAATTAC
UK/1/00     GGAATCAATG TTGCTGAGCA GTCAAAGGAG TGCAACATCA ACATATCCAC TACTAATTAC
NL/2/00     GGAATCAATG TTGCTGAGCA GTCAAAGGAG TGCAACATCA ACATATCCAC TACTAATTAC
NL/13/00    GGAATCAATG TTGCTGAGCA GTCAAAGGAG TGCAACATCA ACATATCCAC TACTAATTAC
NL/14/00    GGAATCAATG TTGCTGAGCA GTCAAAGGAG TGCAACATCA ACATATCCAC TACTAATTAC
FL/3/01     GGAATCAATG TTGCTGAGCA GTCAAAGGAG TGCAACATAA ACATATCTAC TACTAATTAC
FL/4/01     GGAATCAATG TTGCTGAGCA GTCAAAGGAG TGCAACATCA ACATATCTAC TACTAATTAC
FL/8/01     GGAATCAATG TTGCTGAGCA GTCAAAGGAG TGCAACATCA ACATATCTAC TACTAATTAC
UK/1/01     GGAATCAATG TTGCTGAGCA GTCAAAGGAG TGCAACATCA ACATATCCAC TACTAATTAC
UK/7/01     GGAATCAATG TTGCTGAGCA GTCAAAGGAG TGCAACATCA ACATATCCAC TACTAATTAC
FL/10/01    GGAATCAATG TTGCTGAGCA GTCAAAGGAG TGCAACATCA ACATATCCAC TACTAATTAC
NL/6/01     GGAATCAATG TTGCTGAGCA GTCAAAGGAG TGCAACATCA ACATATCCAC TACTAATTAC
NL/8/01     GGAATCAATG TTGCTGAGCA GTCAAAGGAG TGCAACATCA ATATATCCAC TACTAATTAC
NL/10/01    GGAATCAATG TTGCTGAGCA GTCAAAGGAG TGCAACATCA ACATATCCAC TACTAATTAC
NL/14/01    GGAATCAATG TTGCTGAGCA GTCAAAGGAG TGCAACATCA ACATATCCAC TACTAATTAC
NL/20/01    GGAATCAATG TTGCTGAGCA GTCAAAGGAG TGCAACATCA ACATATCCAC TACTAATTAC
NL/25/01    GGAATCAATG TTGCTGAGCA GTCAAAGGAG TGCAACATCA ACATATCCAC CACTAATTAC
NL/26/01    GGAATCAATG TTGCTGAGCA GTCAAAGGAG TGCAACATCA ACATATCCAC TACTAATTAC
NL/28/01    GGAATCAATG TTGCTGAGCA GTCAAAGGAG TGCAACATCA ACATATCTAC TACTAATTAC
NL/30/01    GGAATCAATG TTGCTGAGCA GTCAAAGGAG TGCAACATCA ACATATCCAC TACTAATTAC
BR/2/01     GGAATCAATG TTGCTGAGCA GTCAAAGGAG TGCAACATAA ACATATCTAC TACTAATTAC
BR/3/01     GGAATCAATG TTGCTGAGCA GTCAAAGGAG TGCAACATAA ACATATCTAC TACTAATTAC
NL/2/02     GGAATCAATG TTGCTGAGCA GTCAAAGGAG TGCAACATCA ACATATCCAC CACTAATTAC
NL/4/02     GGAATCAATG TTGCTGAGCA GTCAAAGGAG TGCAACATCA ACATATCCAC TACTAATTAC
NL/5/02     GGAATCAATG TTGCTGAGCA GTCAAAGGAG TGCAACATCA ACATATCCAC CACTAATTAC
NL/6/02     GGAATCAATG TTGCTGAGCA GTCAAAGGAG TGCAACATCA ACATATCCAC CACTAATTAC
NL/7/02     GGAATCAATG TTGCTGAGCA GTCAAAGGAG TGCAACATAA ACATATCTAC TACTAATTAC
```

FIG.17F

| | |
|---|---|
| NL/9/02 | GGAATCAATG TTGCTGAGCA GTCAAAGGAG TGCAACATCA ACATATCCAC TACTAATTAC |
| FL/1/02 | GGAATCAATG TTGCTGAGCA GTCAAAGGAG TGCAACATAA ACATATCTAC TACTAATTAC |
| NL/1/81 | GGAATTAATG TTGCTGAGCA ATCAAAGGAG TGCAACATCA ACATATCCAC TACAAATTAC |
| NL/1/93 | GGAATTAATG TTGCTGAGCA ATCAAAAGAG TGCAACATCA ACATATCCAC TACAAATTAC |
| NL/2/93 | GGAATTAATG TTGCTGAGCA ATCAAAAGAG TGCAACATCA ACATATCCAC TACAAATTAC |
| NL/4/93 | GGAATTAATG TTGCTGAGCA ATCAAAAGAG TGCAACATCA ACATATCCAC TACAAATTAC |
| NL/1/95 | GGAATTAATG TTGCTGAGCA ATCAAAGGAG TGCAACATCA ACATATCCAC CACAAATTAC |
| NL/2/96 | GGAATTAATG TTGCTGAGCA ATCAAAGGAG TGCAACATCA ACATATCCAC TACAAATTAC |
| NL/3/96 | GGAATTAATG TTGCTGAGCA ATCAAAGGAG TGCAACATCA ACATATCCAC CACAAATTAC |
| NL/1/98 | GGAATTAATG TTGCTGAGCA ATCAAAGGAG TGCAACATCA ACATATCCAC TACAAATTAC |
| NL/17/00 | GGAATTAATG TTGCTGAGCA ATCAAAGGAG TGCAACATCA ACATATCCAC TACAAATTAC |
| NL/22/01 | GGAATTAATG TTGCTGAGCA ATCAAAGGAG TGCAACATCA ACATATCCAC CACAAATTAC |
| NL/29/01 | GGAATTAATG TTGCTGAGCA ATCAAAGGAG TGCAACATCA ACATATCCAC TACAAATTAC |
| NL/23/01 | GGAATTAATG TTGCTGAGCA ATCAAAGGAG TGCAACATCA ACATATCCAC CACAAATTAC |
| NL/17/01 | GGAATTAATG TTGCTGAGCA ATCAAAGGAG TGCAACATCA ACATATCCAC TACAAATTAC |
| NL/24/01 | GGAATTAATG TTGCTGAGCA ATCAAAGGAG TGCAACATCA ACATATCCAC CACAAATTAC |
| NL/3/02 | GGAATTAATG TTGCTGAGCA ATCAAAGGAG TGCAACATCA ACATATCCAC TACAAATTAC |
| NL/3/98 | GGGATCAATG TTGCTGAGCA ATCAAGAGAA TGCAACATCA ACATATCTAC TACCAACTAC |
| NL/1/99 | GGGATCAATG TTGCTGAGCA ATCAAGAGAA TGCAACATCA ACATATCTAC TACCAACTAC |
| NL/2/99 | GGGATCAATG TTGCTGAGCA ATCAAGAGAA TGCAACATCA ACATATCTAC TACCAACTAC |
| NL/3/99 | GGGATCAATG TTGCTGAGCA ATCAAGAGAA TGCAACATCA ACATATCTAC TACCAACTAC |
| NL/11/00 | GGGATCAATG TTGCTGAGCA ATCAAGAGAA TGCAACATCA ACATATCTAC TACCAACTAC |
| NL/12/00 | GGGATCAATG TTGCTGAGCA ATCAAGAGAA TGCAACATCA ACATATCTAC TACCAACTAC |
| NL/1/01 | GGGATCAATG TTGCTGAGCA ATCAAGAGAA TGCAACATCA ACATATCTAC TACCAACTAC |
| NL/5/01 | GGGATCAATG TTGCTGAGCA ATCAAGAGAA TGCAACATCA ACATATCTAC TACCAACTAC |
| NL/9/01 | GGGATCAATG TTGCTGAGCA ATCAAGAGAA TGCAACATCA ACATATCTAC TACCAACTAC |
| NL/19/01 | GGGATCAATG TTGCTGAGCA ATCAAGAGAA TGCAACATCA ACATATCTAC TACCAACTAC |
| NL/21/01 | GGGATCAATG TTGCTGAGCA ATCAAGAGAA TGCAACATCA ACATATCTAC TACCAACTAC |
| UK/11/01 | GGGATCAATG TTGCTGAGCA ATCAAGAGAA TGCAACATCA ACATATCTAC TACCAACTAC |
| FL/1/01 | GGGATCAATG TTGCTGAGCA ATCAAGAGAA TGCAACATCA ACATATCTAC TACCAACTAC |
| FL/2/01 | GGGATCAATG TTGCTGAGCA ATCAAGAGAA TGCAACATCA ACATATCTAC TACCAACTAC |
| FL/5/01 | GGGATCAATG TTGCTGAGCA ATCAAGAGAA TGCAACATCA ACATATCTAC TACCAACTAC |
| FL/7/01 | GGGATCAATG TTGCTGAGCA ATCAAGAGAA TGCAACATCA ACATATCTAC TACCAACTAC |
| FL/9/01 | GGGATCAATG TTGCTGAGCA ATCAAGAGAA TGCAACATCA ACATATCTAC TACCAACTAC |
| UK/10/01 | GGGATCAATG TTGCTGAGCA ATCAAGAGAA TGCAACATCA ACATATCTAC TACCAACTAC |
| NL/1/02 | GGGATCAATG TTGCTGAGCA ATCAAGAGAA TGCAACATCA ACATATCTAC TACCAACTAC |
| NL/1/94 | GGGATCAATG TTGCTGAGCA ATCAAGAGAA TGCAACATCA ACATATCTAC CACCAACTAC |
| NL/1/96 | GGGATCAATG TTGCTGAGCA ATCAAGAGAA TGCAACATCA ACATATCTAC CACCAACTAC |
| NL/6/97 | GGGATCAATG TTGCTGAGCA ATCAAGAGAA TGCAACATCA ACATATCTAC CACCAACTAC |
| NL/7/00 | GGGATCAATG TTGCTGAGCA ATCAAGAGAA TGCAACATCA ACATATCTAC AACCAACTAC |
| NL/9/00 | GGGATCAATG TTGCTGAGCA ATCAAGAGAA TGCAACATCA ACATATCCAC AACCAACTAC |
| NL/19/00 | GGGATCAATG TTGCTGAGCA ATCAAGAGAA TGCAACATCA ACATATCTAC TACCAACTAC |
| NL/28/00 | GGGATCAATG TTGCTGAGCA ATCAAGAGAA TGCAACATCA ACATATCTAC AACCAACTAC |
| NL/3/01 | GGGATCAATG TTGCTGAGCA ATCAAGAGAA TGCAACATCA ACATATCTAC AACCAACTAC |
| NL/4/01 | GGGATCAATG TTGCTGAGCA ATCAAGAGAA TGCAACATCA ACATATCTAC AACCAACTAC |
| NL/11/01 | GGGATCAATG TTGCTGAGCA ATCAAGAGAA TGCAACATCA ACATATCTAC AACCAACTAC |
| NL/15/01 | GGGATCAATG TTGCTGAGCA ATCAAGAGAA TGCAACATCA ACATATCTAC AACCAACTAC |
| NL/18/01 | GGGATCAATG TTGCTGAGCA ATCAAGAGAA TGCAACATCA ACATATCTAC AACCAACTAC |
| FL/6/01 | GGGATCAATG TTGCTGAGCA ATCAAGAGAA TGCAACATCA ACATATCTAC AACCAACTAC |
| UK/5/01 | GGGATCAATG TTGCTGAGCA ATCAAGAGAA TGCAACATCA ACATATCCAC AACCAACTAC |
| UK/8/01 | GGGATCAACG TTGCTGAGCA ATCAAGAGAA TGCAACATCA ACATATCTAC CACCAACTAT |
| NL/12/02 | GGGATCAATG TTGCTGAGCA ATCAAGAGAA TGCAACATCA ACATATCTAC AACCAACTAC |
| HK/1/02 | GGGATCAATG TTGCTGAGCA ATCAAGAGAA TGCAACATCA ACATATCTAC AACCAACTAC |

```
         ....|....| ....|....| ....|....| ....|....| ....|....| ....|....|
             305        315        325        335        345        355
```

| | |
|---|---|
| NL/1/00 | CCATGCAAAG TTAGCACAGG AAGACATCCT ATCAGTATGG TTGCACTATC TCCTCTTGGG |
| UK/1/00 | CCATGCAAAG TTAGCACAGG AAGACATCCT ATCAGTATGG TTGCACTGTC TCCTCTTGGG |
| NL/2/00 | CCATGCAAAG TTAGCACAGG AAGACATCCT ATCAGTATGG TTGCACTGTC TCCTCTTGGG |
| NL/13/00 | CCATGCAAAG TTAGCACAGG AAGACATCCT ATCAGTATGG TTGCACTGTC TCCTCTTGGG |
| NL/14/00 | CCATGCAAAG TTAGCACAGG AAGACATCCT ATCAGTATGG TTGCACTGTC TCCTCTTGGG |

FIG. 17G

| | | | | | | |
|---|---|---|---|---|---|---|
| FL/3/01 | CCATGCAAAG | TTAGCACAGG | AAGACATCCT | ATCAGTATGG | TTGCACTGTC | TCCTCTTGGG |
| FL/4/01 | CCATGCAAAG | TTAGCACAGG | AAGACATCCT | ATCAGTATGG | TTGCACTGTC | TCCTCTTGGG |
| FL/8/01 | CCATGCAAAG | TTAGCACAGG | AAGACATCCT | ATCAGTATGG | TTGCACTGTC | TCCTCTTGGG |
| UK/1/01 | CCATGCAAAG | TTAGCACAGG | AAGACATCCT | ATCAGTATGG | TTGCACTGTC | TCCTCTTGGG |
| UK/7/01 | CCATGCAAAG | TTAGCACAGG | AAGACATCCT | ATCAGTATGG | TTGCACTGTC | TCCTCTTGGG |
| FL/10/01 | CCATGCAAAG | TTAGCACAGG | AAGACATCCT | ATCAGTATGG | TTGCACTGTC | TCCTCTTGGG |
| NL/6/01 | CCATGCAAAG | TTAGCACAGG | AAGACATCCT | ATCAGTATGG | TTGCACTGTC | TCCTCTTGGG |
| NL/8/01 | CCATGCAAAG | TTAGCACAGG | AAGACATCCT | ATCAGTATGG | TTGCACTGTC | TCCTCTTGGG |
| NL/10/01 | CCATGCAAAG | TTAGCACAGG | AAGACATCCT | ATCAGTATGG | TTGCACTGTC | TCCTCTTGGG |
| NL/14/01 | CCATGCAAAG | TTAGCACAGG | AAGACATCCT | ATCAGTATGG | TTGCACTGTC | TCCTCTTGGG |
| NL/20/01 | CCATGCAAAG | TTAGCACAGG | AAGACATCCT | ATCAGTATGG | TTGCACTGTC | TCCTCTTGGG |
| NL/25/01 | CCATGCAAAG | TTAGCACAGG | AAGACATCCT | ATCAGTATGG | TTGCACTGTC | TCCTCTTGGG |
| NL/26/01 | CCATGCAAAG | TTAGCACAGG | AAGACATCCT | ATCAGTATGG | TTGCACTGTC | TCCTCTTGGG |
| NL/28/01 | CCATGCAAAG | TTAGCACAGG | AAGACATCCT | ATCAGTATGG | TTGCACTGTC | TCCTCTTGGG |
| NL/30/01 | CCATGCAAAG | TTAGCACAGG | AAGACATCCT | ATCAGTATGG | TTGCACTGTC | TCCTCTTGGG |
| BR/2/01 | CCATGCAAAG | TTAGCACAGG | AAGACATCCT | ATCAGTATGG | TTGCACTATC | TCCTCTTGGG |
| BR/3/01 | CCATGCAAAG | TTAGCACAGG | AAGACATCCT | ATCAGTATGG | TTGCACTATC | TCCTCTTGGG |
| NL/2/02 | CCATGCAAAG | TTAGCACAGG | AAGACATCCT | ATCAGTATGG | TTGCACTGTC | TCCTCTTGGG |
| NL/4/02 | CCATGCAAAG | TTAGCACAGG | AAGACATCCT | ATCAGTATGG | TTGCACTGTC | TCCTCTTGGG |
| NL/5/02 | CCATGCAAAG | TTAGCACAGG | AAGACATCCT | ATCAGTATGG | TTGCACTGTC | TCCTCTTGGG |
| NL/6/02 | CCATGCAAAG | TTAGCACAGG | AAGACATCCT | ATCAGTATGG | TTGCACTGTC | TCCTCTTGGG |
| NL/7/02 | CCATGCAAAG | TTAGCACAGG | AAGACATCCT | ATCAGTATGG | TTGCACTATC | TCCTCTTGGG |
| NL/9/02 | CCATGCAAAG | TTAGCACAGG | AAGACATCCT | ATCAGTATGG | TTGCACTGTC | TCCTCTTGGG |
| FL/1/02 | CCATGCAAAG | TTAGCACAGG | AAGACATCCT | ATCAGTATGG | TTGCACTATC | TCCTCTTGGG |
| NL/1/81 | CCATGCAAAG | TCAGCACAGG | AAGACATCCT | ATCAGTATGG | TTGCACTGTC | CCCTCTTGGG |
| NL/1/93 | CCATGCAAAG | TCAGCACAGG | AAGACATCCT | ATCAGTATGG | TTGCACTGTC | CCCTCTTGGG |
| NL/2/93 | CCATGCAAAG | TCAGCACAGG | AAGACATCCT | ATCAGTATGG | TTGCACTGTC | TCCTCTTGGG |
| NL/4/93 | CCATGCAAAG | TCAGCACAGG | AAGACATCCT | ATCAGTATGG | TTGCACTGTC | CCCTCTTGGG |
| NL/1/95 | CCATGCAAAG | TCAGCACAGG | AAGGCATCCT | ATCAGTATGG | TTGCACTGTC | CCCTCTTGGG |
| NL/2/96 | CCATGCAAAG | TCAGCACAGG | AAGACATCCT | ATCAGTATGG | TTGCACTGTC | TCCTCTTGGG |
| NL/3/96 | CCATGCAAAG | TCAGCACAGG | AAGGCATCCT | ATCAGTATGG | TTGCACTGTC | CCCTCTTGGG |
| NL/1/98 | CCATGCAAAG | TCAGCACAGG | AAGACATCCT | ATCAGTATGG | TTGCACTGTC | TCCTCTTGGG |
| NL/17/00 | CCATGCAAAG | TCAGCACAGG | AAGACATCCT | ATCAGTATGG | TTGCACTGTC | TCCTCTTGGG |
| NL/22/01 | CCATGCAAAG | TCAGCACAGG | AAGGCATCCT | ATCAGTATGG | TTGCACTGTC | CCCTCTCGGG |
| NL/29/01 | CCATGCAAAG | TCAGCACAGG | AAGACATCCT | ATCAGTATGG | TTGCACTGTC | TCCTCTTGGG |
| NL/23/01 | CCATGCAAAG | TCAGCACAGG | AAGGCATCCT | ATCAGTATGG | TTGCACTGTC | CCCTCTCGGG |
| NL/17/01 | CCATGCAAAG | TCAGCACAGG | AAGACATCCT | ATCAGTATGG | TTGCACTGTC | TCCTCTTGGG |
| NL/24/01 | CCATGCAAAG | TCAGCACAGG | AAGGCATCCT | ATCAGTATGG | TTGCACTGTC | CCCTCTCGGG |
| NL/3/02 | CCATGCAAAG | TCAGCACAGG | AAGACATCCT | ATCAGTATGG | TTGCACTGTC | TCCTCTTGGG |
| NL/3/98 | CCATGCAAAG | TCAGCACAGG | AAGACACCCT | ATAAGCATGG | TTGCACTATC | ACCTCTCGGT |
| NL/1/99 | CCATGCAAAG | TCAGCACAGG | AAGACACCCT | ATAAGCATGG | TTGCACTATC | ACCTCTCGGT |
| NL/2/99 | CCATGCAAAG | TCAGCACAGG | AAGACACCCT | ATAAGCATGG | TTGCACTATC | ACCTCTCGGT |
| NL/3/99 | CCATGCAAAG | TCAGCACAGG | AAGACACCCT | ATAAGCATGG | TTGCACTATC | ACCTCTCGGT |
| NL/11/00 | CCATGCAAAG | TCAGCACAGG | AAGACACCCT | ATAAGCATGG | TTGCACTATC | ACCTCTCGGT |
| NL/12/00 | CCATGCAAAG | TCAGCACAGG | AAGACACCCT | ATAAGCATGG | TTGCACTATC | ACCTCTCGGT |
| NL/1/01 | CCATGCAAAG | TCAGCACAGG | AAGACACCCT | ATAAGCATGG | TTGCACTATC | ACCTCTCGGT |
| NL/5/01 | CCATGCAAAG | TCAGCACAGG | AAGACACTCT | ATAAGCATGG | TTGCACTATC | ACCTCTCGGT |
| NL/9/01 | CCATGCAAAG | TCAGCACAGG | AAGACACCCT | ATAAGCATGG | TtGCACTATC | ACCTCTCGGT |
| NL/19/01 | CCATGCAAAG | TCAGCACAGG | AAGACACCCT | ATAAGCATGG | TTGCACTATC | ACCTCTCGGT |
| NL/21/01 | CCATGCAAAG | TCAGCACAGG | AAGACACCCT | ATAAGCATGG | TTGCACTATC | ACCTCTCGGT |
| UK/11/01 | CCATGCAAAG | TCAGCACAGG | AAGACACCCT | ATAAGCATGG | TTGCACTATC | ACCTCTCGGT |
| FL/1/01 | CCATGCAAAG | TCAGCACAGG | AAGACACCCT | ATAAGCATGG | TTGCACTATC | ACCTCTCGGT |
| FL/2/01 | CCATGCAAAG | TCAGCACAGG | AAGACACCCT | ATAAGCATGG | TTGCACTATC | ACCTCTCGGT |
| FL/5/01 | CCATGCAAAG | TCAGCACAGG | AAGACACCCT | ATAAGCATGG | TTGCACTATC | ACCTCTCGGT |
| FL/7/01 | CCATGCAAAG | TCAGCACAGG | AAGACACCCT | ATAAGCATGG | TTGCACTATC | ACCTCTCGGT |
| FL/9/01 | CCATGCAAAG | TCAGCACAGG | AAGACACCCT | ATAAGCATGG | TTGCACTATC | ACCTCTCGGT |
| UK/10/01 | CCATGCAAAG | TCAGCACAGG | AAGACACCCT | ATAAGCATGG | TTGCACTATC | ACCTCTCGGT |
| NL/1/02 | CCATGCAAAG | TCAGCACAGG | AAGACACCCT | ATAAGCATGG | TTGCACTATC | ACCTCTCGGT |
| NL/1/94 | CCATGCAAAG | TCAGCACAGG | AAGACACCCT | ATCAGCATGG | TTGCACTATC | ACCTCTCGGT |
| NL/1/96 | CCATGCAAAG | TCAGCACAGG | AAGACACCCC | ATCAGCATGG | TTGCACTATC | ACCTCTCGGT |
| NL/6/97 | CCATGCAAAG | TCAGCACAGG | AAGACACCCT | ATCAGCATGG | TTGCACTATC | ACCTCTCGGT |

FIG.17H

| | | | | | | |
|---|---|---|---|---|---|---|
| NL/7/00  | CCATGCAAAG | TCAGCACAGG | AAGACACCCT | ATCAGCATGG | TTGCACTATC | ACCTCTCGGT |
| NL/9/00  | CCATGCAAAG | TCAGCACAGG | AAGACACCCT | ATCAGCATGG | TTGCACTGTC | ACCTCTCGGC |
| NL/19/00 | CCATGCAAAG | TCAGCACAGG | AAGACACCCT | ATCAGCATGG | TTGCACTATC | ACCTCTCGGT |
| NL/28/00 | CCATGCAAAG | TCAGCACAGG | AAGACACCCT | ATCAGCATGG | TTGCACTATC | ACCTCTCGGT |
| NL/3/01  | CCATGCAAAG | TCAGCACAGG | AAGACACCCT | ATCAGCATGG | TTGCACTATC | ACCTCTCGGT |
| NL/4/01  | CCATGCAAAG | TCAGCACAGG | AAGACACCCT | ATCAGCATGG | TTGCACTATC | ACCTCTCGGT |
| NL/11/01 | CCATGCAAAG | TCAGCACAGG | AAGACACCCT | ATCAGCATGG | TTGCACTATC | ACCTCTCGGT |
| NL/15/01 | CCATGCAAAG | TCAGCACAGG | AAGACACCCT | ATCAGCATGG | TTGCACTATC | ACCTCTCGGT |
| NL/18/01 | CCATGCAAAG | TCAGCACAGG | AAGACACCCT | ATCAGCATGG | TTGCACTATC | ACCTCTCGGT |
| FL/6/01  | CCATGCAAAG | TCAGCACAGG | AAGACACCCT | ATCAGCATGG | TTGCACTATC | ACCTCTCGGT |
| UK/5/01  | CCATGCAAAG | TCAGCACAGG | AAGACACCCT | ATCAGCATGG | TTGCACTGTC | ACCTCTCGGC |
| UK/8/01  | CCGTGCAAAG | TCAGCACAGG | AAGACACCCT | ATCAGCATGG | TTGCACTATC | ACCTCTCGGT |
| NL/12/02 | CCATGCAAAG | TCAGCACAGG | AAGACACCCT | ATCAGCATGG | TTGCACTATC | ACCTCTCGGT |
| HK/1/02  | CCATGCAAAG | TCAGCACAGG | AAGACACCCT | ATCAGCATGG | TTGCACTATC | ACCTCTCGGT |

```
          ....|....| ....|....| ....|....| ....|....| ....|....| ....|....|
             365        375        385        395        405        415
```

| | | | | | | |
|---|---|---|---|---|---|---|
| NL/1/00  | GCTTTGGTTG | CTTGCTACAA | GGGAGTGAGC | TGTTCCATTG | GCAGCAACAG | AGTAGGGATC |
| UK/1/00  | GCTTTGGTTG | CTTGCTACAA | GGGAGTGAGC | TGTTCCATTG | GCAGCAACAG | AGTAGGGATC |
| NL/2/00  | GCTTTGGTTG | CTTGCTACAA | GGGAGTGAGC | TGTTCCATTG | GCAGCAACAG | AGTAGGGATC |
| NL/13/00 | GCTTTGGTTG | CTTGCTACAA | GGGAGTGAGC | TGTTCCATTG | GCAGCAACAG | AGTAGGGATC |
| NL/14/00 | GCTTTGGTTG | CTTGCTACAA | GGGAGTGAGC | TGTTCCATTG | GTAGCAACAG | AGTAGGGATC |
| FL/3/01  | GCTTTGGTTG | CTTGCTACAA | GGGAGTGAGC | TGTTCCATTG | GCAGCAACAG | AGTAGGGATC |
| FL/4/01  | GCTTTGGTTG | CTTGCTACAA | GGGAGTGAGC | TGTTCCATTG | GCAGCAACAG | AGTAGGGATC |
| FL/8/01  | GCTTTGGTTG | CTTGCTACAA | GGGAGTGAGC | TGTTCCATTG | GCAGCAACAG | AGTAGGGATC |
| UK/1/01  | GCTTTGGTTG | CTTGCTACAA | GGGAGTGAGC | TGTTCCATTG | GCAGCAACAG | AGTAGGAATC |
| UK/7/01  | GCTTTGGTTG | CTTGCTACAA | GGGAGTGAGC | TGTTCCATTG | GCAGCAACAG | AGTAGGGATC |
| FL/10/01 | GCTTTGGTTG | CTTGCTACAA | GGGAGTGAGC | TGTTCCATTG | GCAGCAACAG | AGTAGGGATC |
| NL/6/01  | GCTTTGGTTG | CTTGCTACAA | GGGAGTGAGC | TGTTCCATTG | GCAGCAACAG | AGTAGGGATC |
| NL/8/01  | GCTTTGGTTG | CTTGCTACAA | GGGAGTGAGC | TGTTCCATTG | GCAGCAACAG | AGTAGGGATC |
| NL/10/01 | GCTTTGGTTG | CTTGCTACAA | GGGAGTGAGC | TGTTCCATTG | GCAGCAACAG | AGTAGGGATC |
| NL/14/01 | GCTTTGGTTG | CTTGCTACAA | GGGAGTGAGC | TGTTCTATTG | GCAGCAACAG | AGTAGGGATC |
| NL/20/01 | GCTTTGGTTG | CTTGCTACAA | GGGAGTGAGC | TGTTCCATTG | GCAGCAACAG | AGTAGGGATC |
| NL/25/01 | GCTTTGGTTG | CTTGCTACAA | GGGAGTGAGC | TGTTCCATTG | GCAGCAACAG | AGTAGGGATC |
| NL/26/01 | GCTTTGGTTG | CTTGCTACAA | GGGAGTGAGC | TGTTCCATTG | GCAGCAACAG | AGTAGGGATC |
| NL/28/01 | GCTTTGGTTG | CTTGCTACAA | GGGAGTGAGC | TGTTCCATTG | GCAGCAACAG | AGTAGGGATC |
| NL/30/01 | GCTTTGGTTG | CTTGCTACAA | GGGAGTGAGC | TGTTCCATTG | GCAGCAACAG | AGTAGGGATC |
| BR/2/01  | GCTTTGGTTG | CTTGCTaCAA | GGGAGTGAGC | TGTTCCATTG | GCAGCAACAG | AGTAGGGATC |
| BR/3/01  | GCTTTGGTTG | CTTGCTACAA | GGGAGTGAGC | TGTTCCATTG | GCAGCAACAG | AGTAGGGATC |
| NL/2/02  | GCTTTGGTTG | CTTGCTACAA | GGGAGTGAGC | TGTTCCATTG | GCAGCAACAG | AGTAGGGATC |
| NL/4/02  | GCTCTGGTTG | CTTGCTACAA | GGGAGTGAGC | TGCTCCATTG | GCAGCAACAG | AGTAGGGATC |
| NL/5/02  | GCTTTGGTTG | CTTGCTACAA | GGGAGTGAGC | TGTTCCATTG | GCAGCAACAG | AGTAGGGATC |
| NL/6/02  | GCTTTGGTTG | CTTGCTACAA | GGGAGTGAGC | TGTTCCATTG | GCAGCAACAG | AGTAGGGATC |
| NL/7/02  | GCTTTGGTTG | CTTGCTACAA | GGGAGTGAGC | TGTTCCATTG | GCAGCAACAG | AGTAGGGATC |
| NL/9/02  | GCTTTGGTTG | CTTGCTACAA | GGGAGTGAGC | TGTTCCATTG | GCAGCAACAG | AGTAGGGATC |
| FL/1/02  | GCTTTGGTTG | CTTGCTACAA | GGGAGTGAGC | TGTTCCATTG | GCAGCAACAG | AGTAGGGATC |
| NL/1/81  | GCTCTGGTTG | CTTGCTACAA | AGGAGTAAGC | TGTTCCATTG | GCAGCAATAG | AGTAGGGATT |
| NL/1/93  | GCTCTAGTTG | CTTGCTACAA | AGGAGTAAGC | TGTTCCATTG | GCAGCAATAG | AGTAGGGATC |
| NL/2/93  | GCTCTAGTTG | CTTGCTACAA | AGGAGTAAGC | TGTTCCATTG | GCAGCAATAG | AGTAGGGATC |
| NL/4/93  | GCTCTAGTTG | CTTGCTACAA | AGGAGTAAGC | TGTTCCATTG | GCAGCAATAG | AGTAGGGATC |
| NL/1/95  | GCTCTGGTTG | CTTGTTACAA | AGGAGTAAGC | TGTTCTATTG | GCAGCAATAG | AGTAGGGATC |
| NL/2/96  | GCTCTAGTTG | CTTGCTACAA | AGGAGTAAGC | TGTTCCATTG | GCAGCAACAG | AGTAGGGATC |
| NL/3/96  | GCTCTGGTTG | CTTGTTACAA | AGGAGTAAGC | TGTTCTATTG | GCAGCAACAG | AGTAGGGATC |
| NL/1/98  | GCTCTGGTTG | CTTGCTACAA | AGGAGTAAGC | TGTTCCATTG | GCAGCAACAG | AGTAGGGATC |
| NL/17/00 | GCTCTGGTTG | CTTGCTACAA | AGGAGTAAGC | TGTTCCATTG | GCAGCAACAG | AGTAGGGATC |
| NL/22/01 | GCTCTGGTTG | CCTGTTACAA | AGGAGTAAGT | TGTTCCATTG | GCAGCAATAG | AGTAGGGATC |
| NL/29/01 | GCTCTGGTTG | CTTGCTACAA | AGGAGTAAGC | TGTTCCATTG | GCAGCAATAG | AGTAGGGATC |
| NL/23/01 | GCTCTGGTTG | CCTGTTACAA | AGGAGTAAGT | TGTTCCATTG | GCAGCAATAG | AGTAGGGATC |
| NL/17/01 | GCTCTGGTTG | CTTGCTACAA | AGGAGTAAGC | TGTTCCATTG | GCAGCAACAG | AGTAGGGATC |
| NL/24/01 | GCTCTGGTTG | CCTGTTACAA | AGGAGTAAGT | TGTTCCATTG | GCAGCAATAG | AGTAGGGATC |
| NL/3/02  | GCTCTGGTTG | CTTGCTACAA | AGGAGTAAGC | TGTTCCATTG | GCAGCAACAG | AGTAGGGATC |

FIG.17I

```
NL/3/98      GCTTTGGTGG CTTGCTATAA AGGGGTAAGC TGCTCGATTG GCAGCAATCG GGTTGGAATC
NL/1/99      GCTTTGGTGG CTTGCTATAA AGGGGTAAGC TGCTCGATTG GCAGCAATTG GGTTGGAATC
NL/2/99      GCTTTGGTGG CTTGCTATAA AGGGGTAAGC TGCTCGATTG GCAGCAATCG GGTTGGAATC
NL/3/99      GCTTTGGTGG CTTGCTATAA AGGGGTAAGC TGCTCGATTG GCAGCAATCG GGTTGGAATC
NL/11/00     GCTTTGGTGG CTTGCTATAA AGGGGTAAGC TGCTCGATTG GCAGCAATCG GGTTGGAATC
NL/12/00     GCTTTGGTGG CTTGCTATAA AGGGGTAAGC TGCTCGATTG GCAGCAATCG GGTTGGAATC
NL/1/01      GCTTTGGTGG CTTGCTATAA AGGGGTAAGC TGCTCGATTG GCAGCAATCG GGTTGGAATC
NL/5/01      GCTTTGGTGG CTTGCTATAA AGGGGTAAGC TGCTCGATTG GCAGCAATCG GGTTGGAATC
NL/9/01      GCTTTGGTGG CTTGCTATAA AGGGGTAAGC TGCTCGATTG GCAGCAATCG GGTTGGAATC
NL/19/01     GCTTTGGTGG CTTGCTATAA AGGGGTAAGC TGCTCGATTG GCAGCAATCG GGTTGGAATC
NL/21/01     GCTTTGGTGG CTTGCTATAA AGGGGTAAGC TGCTCGATTG GCAGCAATCG GGTTGGAATC
UK/11/01     GCTTTGGTGG CTTGCTATAA AGGGGTAAGC TGCTCGATTG GCAGCAATCG GGTTGGAATC
FL/1/01      GCTTTGGTGG CTTGCTATAA AGGGGTAAGC TGCTCGATTG GCAGCAATCG GGTTGGAATT
FL/2/01      GCTTTGGTGG CTTGCTATAA AGGGGTAAGC TGCTCGATTG GCAGCAATCG GGTTGGAATC
FL/5/01      GCTTTGGTGG CTTGCTATAA AGGGGTAAGC TGCTCGATTG GCAGCAATCG GGTTGGAATC
FL/7/01      GCTTTGGTGG CTTGCTATAA AGGGGTAAGC TGCTCGATTG GCAGCAATCG GGTTGGAATC
FL/9/01      GCTTTGGTGG CTTGCTATAA AGGGGTAAGC TGCTCGATTG GCAGCAATCG GGTTGGAATC
UK/10/01     GCTTTGGTGG CTTGCTATAA AGGGGTAAGC TGCTCGATTG GCAGCAATCG GGTTGGAATC
NL/1/02      GCTTTGGTGG CTTGCTATAA AGGGGTAAGC TGCTCGATTG GCAGCAATCG GGTTGGAATC
NL/1/94      GCTTTGGTaG CTTGcTaCaA GGGGGTTAGC TGCTCGATTG GCAGTAATCG GGTTGGAATA
NL/1/96      GCTTTGGTAG CTTGCTACAA AGGGGTTAGC TGCTCGATTG GCAGTAATCG GGTTGGAATA
NL/6/97      GCTTTGGTAG CTTGCTACAA AGGGGTTAGC TGCTCGATTG GCAGTAATCG GGTTGGAATA
NL/7/00      GCTTTGGTAG CTTGCTACAA AGGGGTTAGC TGTTCGATTG GCAGTAATCG GGTTGGAATA
NL/9/00      GCTTTGGTAG CTTGCTACAA AGGGGTTAGC TGTTCGATTG GCAGTAATCG GGTTGGAATA
NL/19/00     GCTTTGGTAG CTTGCTACAA AGGGGTTAGC TGTTCGATTG GCAGTAATCG GGTTGGAATA
NL/28/00     GCTTTGGTAG CTTGCTACAA AGGGGTTAGC TGTTCGATTG GCAGTAATCG GGTTGGAATA
NL/3/01      GCTTTGGTAG CTTGCTACAA AGGGGTTAGC TGTTCGATTG GCAGTAATCG GGTTGGAATA
NL/4/01      GCTTTGGTAG CTTGCTACAA AGGGGTTAGC TGTTCGATTG GCAGTAATCG GGTTGGAATA
NL/11/01     GCTTTGGTAG CTTGCTACAA AGGGGTTAGC TGTTCGATTG GCAGTAATCG GGTTGGAATA
NL/15/01     GCTTTGGTAG CTTGCTACAA AGGGGTTAGC TGTTCAATTG GCAGTAATCG GGTTGGAATA
NL/18/01     GCTTTGGTAG CTTGCTACAA AGGGGTTAGC TGTTCAATTG GCAGTAATCG GGTTGGAATA
FL/6/01      GCTTTGGTAG CTTGCTACAA GGGGGTTAGC TGTTCGATTG GCAGTAATCG GGTTGGAATA
UK/5/01      GCTTTGGTAG CTTGCTACAA AGGGGTTAGC TGTTCGATTG GCAGTAATCG GGTTGGAATA
UK/8/01      GCTTTGGTAG CTTGCTACAA AGGGGTTAGC TGCTCGATTG GCAGTAATCG GGTTGGAATA
NL/12/02     GCTTTGGTAG CTTGCTACAA AGGGGTTAGC TGTTCAATTG GCAGTAATCG GGTTGGAATA
HK/1/02      GCTTTGGTAG CTTGCTACAA AGGGGTTAGC TGTTCGATTG GCAGTAATCG GGTTGGAATA

....|....| ....|....| ....|....
                425        435        445
NL/1/00      ATCAAGCAAC TGAACAAAGG CTGCTCTTA
UK/1/00      ATCAAGCAAC TGAACAAAGG CTGCTCTTA
NL/2/00      ATCAAGCAAC TGAACAAAGG CTGCTCTTA
NL/13/00     ATCAAGCAAC TGAACAAAGG CTGCTCTTA
NL/14/00     ATCAAGCAAC TGAACAAAGG CTGCTCTTA
FL/3/01      ATCAAGCAAC TGAACAAAGG CTGCTCTTA
FL/4/01      ATCAAGCAAC TGAACAAAGG CTGCTCTTA
FL/8/01      ATCAAGCAAC TGAACAAAGG CTGCTCTTA
UK/1/01      ATCAAGCAAC TGAACAAAGG CTGCTCTTA
UK/7/01      ATCAAGCAAC TGAACAAAGG CTGCTCTTA
FL/10/01     ATCAAGCAAC TGAACAAAGG CTGCTCTTA
NL/6/01      ATCAAGCAAC TGAACAAAGG CTGCTCTTA
NL/8/01      ATCAAGCAAC TGAACAAAGG CTGCTCTTA
NL/10/01     ATCAAGCAAC TGAACAAAGG CTGCTCTTA
NL/14/01     ATCAAGCAAC TGAACAAAGG CTGCTCTTA
NL/20/01     ATCAAGCAAC TGAACAAAGG CTGCTCTTA
NL/25/01     ATCAAGCAAC TGAACAAAGG CTGCTCTTA
NL/26/01     ATCAAGCAAC TGAACAAAGG CTGCTCTTA
NL/28/01     ATCAAGCAAC TGAACAAAGG CTGCTCTTA
NL/30/01     ATCAAGCAAC TGAACAAAGG CTGCTCTTA
BR/2/01      ATCAAGCAAC TGAACAAAGG CTGCTCTTA
BR/3/01      ATCAAGCAAC TGAACAAAGG CTGCTCTTA
```

FIG. 17J

| | | | |
|---|---|---|---|
| NL/2/02 | ATCAAGCAAC | TGAACAAAGG | CTGCTCTTA |
| NL/4/02 | ATCAAGCAAC | TGAACAAAGG | CTGCTCTTA |
| NL/5/02 | ATCAAGCAAC | TGAACAAAGG | CTGCTCTTA |
| NL/6/02 | ATCAAGCAAC | TGAACAAAGG | CTGCTCTTA |
| NL/7/02 | ATCAAGCAAC | TGAACAAAGG | CTGCTCTTA |
| NL/9/02 | ATCAAGCAAC | TGAACAAAGG | CTGCTCTTA |
| FL/1/02 | ATCAAGCAAC | TGAACAAAGG | CTGCTCTTA |
| NL/1/81 | ATCAAGCAGC | TGAACAAAGG | TTGCTCTTA |
| NL/1/93 | ATCAAGCAGC | TGAACAAAGG | TTGCTCCTA |
| NL/2/93 | ATCAAGCAGC | TGAACAAAGG | TTGCTCCTA |
| NL/4/93 | ATCAAGCAGC | TGAACAAAGG | TTGCTCCTA |
| NL/1/95 | ATCAAGCAGC | TGAACAAAGG | TTGCTCTTA |
| NL/2/96 | ATCAAGCAGC | TGAACAAAGG | TTGCTCCTA |
| NL/3/96 | ATCAAGCAGC | TGAACAAAGG | TTGCTCTTA |
| NL/1/98 | ATCAAGCAGC | TGAACAAAGG | TTGCTCCTA |
| NL/17/00 | ATCAAGCAGC | TGAACAAAGG | TTGCTCCTA |
| NL/22/01 | ATCAAGCAGC | TGAACAAAGG | TTGCTCTTA |
| NL/29/01 | ATAAAGCAGC | TGAACAAAGG | TTGCTCCTA |
| NL/23/01 | ATCAAGCAGC | TGAACAAAGG | TTGCTCTTA |
| NL/17/01 | ATCAAGCAGC | TGAACAAAGG | TTGCTCCTA |
| NL/24/01 | ATCAAGCAGC | TGAACAAAGG | TTGCTCTTA |
| NL/3/02 | ATAAAGCAGC | TGAACAAAGG | TTGCTCCTA |
| NL/3/98 | ATCAAACAAT | TACCTAAAGG | CTGCTCATA |
| NL/1/99 | ATCAAACAAT | TACCCAAAGG | CTGCTCATA |
| NL/2/99 | ATCAAACAAT | TACCCAAAGG | CTGCTCATA |
| NL/3/99 | ATCAAACAAT | TACCCAAAGG | CTGCTCATA |
| NL/11/00 | ATCAAACAAT | TACCTAAAGG | CTGCTCATA |
| NL/12/00 | ATCAAACAAT | TACCTAAAGG | CTGCTCATA |
| NL/1/01 | ATCAAACAAT | TACCTAAAGG | CTGCTCATA |
| NL/5/01 | ATCAAACAAT | TACCTAAAGG | CTGCTCATA |
| NL/9/01 | ATCAAACAAT | TACCTAAAGG | CTGCTCATA |
| NL/19/01 | ATCAAACAAT | TACCTAAAGG | CTGCTCATA |
| NL/21/01 | ATCAAACAAT | TACCTAAAGG | CTGCTCATA |
| UK/11/01 | ATCAAACAAT | TACCCAAAGG | CTGCTCATA |
| FL/1/01 | ATCAAACAAT | TACCTAAAGG | CTGCTCATA |
| FL/2/01 | ATCAAACAAT | TACCTAAAGG | CTGCTCATA |
| FL/5/01 | ATCAAACAAT | TACCTAAAGG | CTGCTCATA |
| FL/7/01 | ATCAAACAAT | TACCTAAAGG | CTGCTCATA |
| FL/9/01 | ATCAAACAAT | TACCTAAAGG | CTGCTCATA |
| UK/10/01 | ATCAAACAAT | TACCCAAAGG | CTGCTCATA |
| NL/1/02 | ATCAAACAAT | TACCTAAAGG | CTGCTCATA |
| NL/1/94 | ATCAAACAAC | TACCTAAAGG | CTGCTCATA |
| NL/1/96 | ATCAAACAAC | TACCTAAAGG | CTGCTCATA |
| NL/6/97 | ATCAAACAAC | TACCTAAAGG | CTGCTCATA |
| NL/7/00 | ATCAAACAAC | TACCTAAAGG | CTGCTCATA |
| NL/9/00 | ATCAAACAAC | TACCTAAAGG | CTGCTCATA |
| NL/19/00 | ATCAAACAAC | TACCTAAAGG | CTGCTCATA |
| NL/28/00 | ATCAAACAAC | TACCTAAAGG | CTGCTCATA |
| NL/3/01 | ATCAAACAAC | TACCTAAAGG | CTGCTCATA |
| NL/4/01 | ATCAAACAAC | TACCTAAAGG | CTGCTCATA |
| NL/11/01 | ATCAAACAAC | TACCTAAAGG | CTGCTCATA |
| NL/15/01 | ATCAAACAAC | TACCTAAAGG | CTGCTCATA |
| NL/18/01 | ATCAAACAAC | TACCTAAAGG | CTGCTCATA |
| FL/6/01 | ATCAAACAAC | TACCTAAAGG | CTGCTCATA |
| UK/5/01 | ATCAAACAAC | TACCTAAAGG | CTGCTCATA |
| UK/8/01 | ATCAAACAAC | TACCTAAAGG | CTGCTCATA |
| NL/12/02 | ATCAAACAAC | TACCTAAAGG | CTGCTCATA |
| HK/1/02 | ATCAAACAAC | TACCTAAAGG | CTGCTCATA |

FIG.17K

Alignment: F proteins

```
              ....|....| ....|....| ....|....| ....|....| ....|....| ....|....|
                  5         15        25        35        45        55
NL/1/00       IGVYGSSVIY MVQLPIFGVI DTPCWIVKAA PSCSGKKGNY ACLLREDQGW YCQNAGSTVY
UK/1/00       IGVYGSSVIY MVQLPIFGVI DTPCWIVKAA PSCSEKKGNY ACLLREDQGW YCQNAGSTVY
NL/2/00       IGVYGSSVIY MVQLPIFGVI DTPCWIVKAA PSCSEKKGNY ACLLREDQGW YCQNAGSTVY
NL/13/00      IGVYGSSVIY MVQLPIFGVI DTPCWIVKAA PSCSEKKGNY ACLLREDQGW YCQNAGSTVY
NL/14/00      IGVYGSSVIY MVQLPIFGVI DTPCWIVKAA PSCSEKKGNY ACLLREDQGW YCQNAGSTVY
FL/3/01       IGVYGSSVIY MVQLPIFGVI DTPCWIVKAA PSCSEKKGNY ACLLREDQGW YCQNAGSTVY
FL/4/01       IGVYGSSVIY MVQLPIFGVI DTPCWIVKAA PSCSEKKGNY ACLLREDQGW YCQNAGSTVY
FL/8/01       IGVYGSSVIY MVQLPIFGVI DTPCWIVKAA PSCSEKKGNY ACLLREDQGW YCQNAGSTVY
UK/1/01       IGVYGSSVIY MVQLPIFGVI DTPCWIVKAA PSCSEKKGNY ACLLREDQGW YCQNAGSTVY
UK/7/01       IGVYGSSVIY MVQLPIFGVI DTPCWIVKAA PSCSEKKGNY ACLLREDQGW YCQNAGSTVY
FL/10/01      IGVYGSSVIY MVQLPIFGVI DTPCWIVKAA PSCSEKKGNY ACLLREDQGW YCQNAGSTVY
NL/6/01       IGVYGSSVIY MVQLPIFGVI DTPCWIVKAA PSCSEKKGNY ACLLREDQGW YCQNAGSTVY
NL/8/01       IGVYGSSVIY MVQLPIFGVI DTPCWIVKAA PSCSEKKGNY ACLLREDQGW YCQNAGSTVY
NL/10/01      IGVYGSSVIY MVQLPIFGVI DTPCWIVKAA PSCSEKKGNY ACLLREDQRW YCQNAGSTVY
NL/14/01      IGVYGSSVIY MVQLPIFGVI DTPCWIVKAA PSCSEKKGNY ACLLREDQGW YCQNAGSTVY
NL/20/01      IGVYGSSVIY MVQLPIFGVI DTPCWIVKAA PSCSEKKGNY ACLLREDQGW YCQNAGSTVY
NL/25/01      IGVYGSSVIY MVQLPIFGVI DTPCWIVKAA PSCSEKKGNY ACLLREDQGW YCQNAGSTVY
NL/26/01      IGVYGSSVIY MVQLPIFGVI DTPCWIVKAA PSCSEKKGNY ACLLREDQGW YCQNAGSTVY
NL/28/01      IGVYGSSVIY MVQLPIFGVI DTPCWIVKAA PSCSEKKGNY ACLLREDQGW YCQNAGSTVY
NL/30/01      IGVYGSSVIY MVQLPIFGVI DTPCWIVKAA PSCSEKKGNY ACLLREDQGW YCQNAGSTVY
BR/2/01       IGVYGSSVIY MVQLPIFGVI DTPCWIVKAA PSCSGKKGNY ACLLREDQGW YCQNAGSTVY
BR/3/01       IGVYGSSVIY MVQLPIFGVI DTPCWIVKAA PSCSGKKGNY ACLLREDQGW YCQNAGSTVY
NL/2/02       IGVYGSSVIY MVQLPIFGVI DTPCWIVKAA PSCSEKKGNY ACLLREDQGW YCQNAGSTVY
NL/4/02       IGVYGSSVIY MVQLPIFGVI DTPCWIVKAA PSCSEKKGNY ACLLREDQGW YCQNAGSTVY
NL/5/02       IGVYGSSVIY MVQLPIFGVI DTPCWIVKAA PSCSEKKGNY ACLLREDQGW YCQNAGSTVY
NL/6/02       IGVYGSSVIY MVQLPIFGVI DTPCWIVKAA PSCSEKKGNY ACLLREDQGW YCQNAGSTVY
NL/7/02       IGVYGSSVIY MVQLPIFGVI DTPCWIVKAA PSCSGKKGNY ACLLREDQGW YCQNAGSTVY
NL/9/02       IGVYGSSVIY MVQLPIFGVI DTPCWIVKAA PSCSEKKGNY ACLLREDQGW YCQNAGSTVY
FL/1/02       IGVYGSSVIY MVQLPIFGVI DTPCWIVKAA PSCSGKKGNY ACLLREDQGW YCQNAGSTVY
NL/1/81       IGVYGSSVIY MVQLPIFGVI DTPCWIVKAA PSCSEKKGNY ACLLREDQGW YCQNAGSTVY
NL/1/93       IGVYGSSVIY MVQLPIFGVI DTPCWIVKAA PSCSEKKGNY ACLLREDQGW YCQNAGSTVY
NL/2/93       IGVYGSSVIY MVQLPIFGVI DTPCWIVKAA PSCSEKKGNY ACLLREDQGW YCQNAGSTVY
NL/4/93       IGVYGSSVIY MVQLPIFGVI DTPCWIVKAA PSCSEKKGNY ACLLREDQGW YCQNAGSTVY
NL/1/95       IGVYGSSVIY MVQLPIFGVI DTPCWIVKAA PSCSEKKGNY ACLLREDQGW YCQNAGSTVY
NL/2/96       IGVYGSSVIY MVQLPIFGVI DTPCWIVKAA PSCSEKKGNY ACLLREDQGW YCQNAGSTVY
NL/3/96       IGVYGSSVIY MVQLPIFGVI DTPCWIVKAA PSCSEKKGNY ACLLREDQGW YCQNAGSTVY
NL/1/98       IGVYGSSVIY MVQLPIFGVI DTPCWIVKAA PSCSEKKGNY ACLLREDQGW YCQNAGSTVY
NL/17/00      IGVYGSSVIY MVQLPIFGVI DTPCWIVKAA PSCSEKKGNY ACLLREDQGW YCQNAGSTVY
NL/22/01      IGVYGSSVIY MVQLPIFGVI DTPCWIVKAA PSCSEKKGNY ACLLREDQGW YCQNAGSTVY
NL/29/01      IGVYGSSVIY MVQLPIFGVI DTPCWIVKAA PSCSEKKGNY ACLLREDQGW YCQNAGSTVY
NL/23/01      IGVYGSSVIY MVQLPIFGVI DTPCWIVKAA PSCSEKKGNY ACLLREDQGW YCQNAGSTVY
NL/17/01      IGVYGSSVIY MVQLPIFGVI DTPCWIVKAA PSCSEKKGNY ACLLREDQGW YCQNAGSTVY
NL/24/01      IGVYGSSVIY MVQLPIFGVI DTPCWIVKAA PSCSEKKGNY ACLLREDQGW YCQNAGSTVY
NL/3/02       IGVYGSSVIY MVQLPIFGVI DTPCWIVKAA PSCSEKKGNY ACLLREDQGW YCQNAGSTVY
NL/3/98       IGVYGSSVIY MVQLPIFGVI DTPCWIIKAA PSCSEKNGNY ACLLREDQGW YCKNAGSTVY
NL/1/99       IGVYGSSVIY MVQLPIFGVI DTPCWIIKAA PSCSEKNGNY ACLLREDQGW YCKNAGSTVY
NL/2/99       IGVYGSSVIY MVQLPIFGVI DTPCWIIKAA PSCSEKNGNY ACLLREDQGW YCKNAGSTVY
NL/3/99       IGVYGSSVIY MVQLPIFGVI DTPCWIIKAA PSCSEKNGNY ACLLREDQGW YCKNAGSTVY
NL/11/00      IGVYGSSVIY MVQLPIFGVI DTPCWIIKAA PSCSEKNGNY ACLLREDQGW YCKNAGSTVY
NL/12/00      IGVYGSSVIY MVQLPIFGVI DTPCWIIKAA PSCSEKNGNY ACLLREDQGW YCKNAGSTVY
NL/1/01       IGVYGSSVIY MVQLPIFGVI DTPCWIIKAA PSCSEKNGNY ACLLREDQGW YCKNAGSTVY
NL/5/01       IGVYGSSVIY MVQLPIFGVI DTPCWIIKAA PSCSEKNGNY ACLLREDQGW YCKNAGSTVY
NL/9/01       IGVYGSSVIY MVQLPIFGVI DTPCWIIKAA PSCSEKNGNY ACLLREDQGW YCKNAGSTVY
NL/19/01      IGVYGSSVIY MVQLPIFGVI DTPCWIIKAA PSCSEKNGNY ACLLREDQGW YCKNAGSTVY
```

FIG. 18A

```
NL/21/01   IGVYGSSVIY MVQLPIFGVI DTPCWIIKAA PSCSEKNGNY ACLLREDQGW YCKNAGSTVY
UK/11/01   IGVYGSSVIY MVQLPIFGVI DTPCWIIKAA PSCSEKNGNY ACLLREDQGW YCKNAGSTVY
FL/1/01    IGVYGSSVIY MVQLPIFGVI DTPCWIIKAA PSCSEKNGNY ACLLREDQGW YCKNAGSTVY
FL/2/01    IGVYGSSVIY MVQLPIFGVI DTPCWIIKAA PSCSEKNGNY ACLLREDQGW YCKNAGSTVY
FL/5/01    IGVYGSSVIY MVQLPIFGVI DTPCWIIKAA PSCSEKNGNY ACLLREDQGW YCKNAGSTVY
FL/7/01    IGVYGSSVIY MVQLPIFGVI DTPCWIIKAA PSCSEKNGNY ACLLREDQGW YCKNAGSTVY
FL/9/01    IGVYGSSVIY MVQLPIFGVI DTPCWIIKAA PSCSEKNGNY ACLLREDQGW YCKNAGSTVY
UK/10/01   IGVYGSSVIY MVQLPIFGVI DTPCWIIKAA PSCSEKNGNY ACLLREDQGW YCKNAGSTVY
NL/1/02    IGVYGSSVIY MVQLPIFGVI DTPCWIIKAA PSCSEKNGNY ACLLREDQGW YCKNAGSTVY
NL/1/94    IGVYGSSVIY MVQLPIFGVI DTPCWIIKAA PSCSEKDGNY ACLLREDQGW YCKNAGSTVY
NL/1/96    IGVYGSSVIY MVQLPIFGVI DTPCWIIKAA PSCSEKDGNY ACLLREDQGW YCKNAGSTVY
NL/6/97    IGVYGSSVIY MVQLPIFGVI DTPCWIIKAA PSCSEKDGNY ACLLREDQGW YCKNAGSTVY
NL/7/00    IGVYGSSVIY MVQLPIFGVI DTPCWIIKAA PSCSEKDGNY ACLLREDQGW YCKNAGSTVY
NL/9/00    IGVYGSSVIY MVQLPIFGVI DTPCWIIKAA PSCSEKDGNY ACLLREDQGW YCKNAGSTVY
NL/19/00   IGVYGSSVIY MVQLPIFGVI DTPCWIIKAA PSCSEKDGNY ACLLREDQGW YCKNAGSTVY
NL/28/00   IGVYGSSVIY MVQLPIFGVI DTPCWIIKAA PSCSEKDGNY ACLLREDQGW YCKNAGSTVY
NL/3/01    IGVYGSSVIY MVQLPIFGVI DTPCWIIKAA PSCSEKDGNY ACLLREDQGW YCKNAGSTVY
NL/4/01    IGVYGSSVIY MVQLPIFGVI DTPCWIIKAA PSCSEKDGNY ACLLREDQGW YCKNAGSTVY
NL/11/01   IGVYGSSVIY MVQLPIFGVI DTPCWIIKAA PSCSEKDGNY ACLLREDQGW YCKNAGSTVY
NL/15/01   IGVYGSSVIY MVQLPIFGVI DTPCWIIKAA PSCSEKDGNY ACLLREDQGW YCKNAGSTVY
NL/18/01   IGVYGSSVIY MVQLPIFGVI DTPCWIIKAA PSCSEKDGNY ACLLREDQGW YCKNAGSTVY
FL/6/01    IGVYGSSVIY MVQLPIFGVI DTPCWIIKAA PSCSEKDGNY ACLLREDQGW YCKNAGSTVY
UK/5/01    IGVYGSSVIY MVQLPIPGVI DTPCWIIKAA PSCSEKDGNY ACLLREDQGW YCKNAGSTVY
UK/8/01    IGVYGSSVIY MVQLPIFGVI DTPCWIIKAA PSCSEKDGNY ACLLREDQGW YCKNAGSTVY
NL/12/02   IGVYGSSVIY MVQLPIFGVI DTPCWIIKAA PSCSEKDGNY ACLLREDQGW YCKNAGSTVY
HK/1/02    IGVYGSSVIY MVQLPIFGVI DTPCWIIKAA PSCSEKDGNY ACLLREDQGW YCKNAGSTVY

....|....| ....|....| ....|....| ....|....| ....|....| ....|....|
                  65         75         85         95        105        115
NL/1/00    YPNEKDCETR GDHVFCDTAA GINVAEQSKE CNINISTTNY PCKVSTGRHP ISMVALSPLG
UK/1/00    YPNEKDCETR GDHVFCDTAA GINVAEQSKE CNINISTTNY PCKVSTGRHP ISMVALSPLG
NL/2/00    YPNEKDCETR GDHVFCDTAA GINVAEQSKE CNINISTTNY PCKVSTGRHP ISMVALSPLG
NL/13/00   YPNEKDCETR GDHVFCDTAA GINVAEQSKE CNINISTTNY PCKVSTGRHP ISMVALSPLG
NL/14/00   YPNEKDCETR GDHVFCDTAA GINVAEQSKE CNINISTTNY PCKVSTGRHP ISMVALSPLG
FL/3/01    YPNEKDCETR GDHVFCDTAA GINVAEQSKE CNINISTTNY PCKVSTGRHP ISMVALSPLG
FL/4/01    YPNEKDCETR GDHVFCDTAA GINVAEQSKE CNINISTTNY PCKVSTGRHP ISMVALSPLG
FL/8/01    YPNEKDCETR GDHVFCDTAA GINVAEQSKE CNINISTTNY PCKVSTGRHP ISMVALSPLG
UK/1/01    YPNEKDCETR GDHVFCDTAA GINVAEQSKE CNINISTTNY PCKVSTGRHP ISMVALSPLG
UK/7/01    YPNEKDCETR GDHVFCDTAA GINVAEQSKE CNINISTTNY PCKVSTGRHP ISMVALSPLG
FL/10/01   YPNEKDCETR GDHVFCDTAA GINVAEQSKE CNINISTTNY PCKVSTGRHP ISMVALSPLG
NL/6/01    YPNEKDCETR GDHVFCDTAA GINVAEQSKE CNINISTTNY PCKVSTGRHP ISMVALSPLG
NL/8/01    YPNEKDCETR GDHVFCDTAA GINVAEQSKE CNINISTTNY PCKVSTGRHP ISMVALSPLG
NL/10/01   YPNEKDCETR GDHVFCDTAA GINVAEQSKE CNINISTTNY PCKVSTGRHP ISMVALSPLG
NL/14/01   YPNEKDCETR GDHVFCDTAA GINVAEQSKE CNINISTTNY PCKVSTGRHP ISMVALSPLG
NL/20/01   YPNEKDCETR GDHVFCDTAA GINVAEQSKE CNINISTTNY PCKVSTGRHP ISMVALSPLG
NL/25/01   YPNEKDCETR GDHVFCDTAA GINVAEQSKE CNINISTTNY PCKVSTGRHP ISMVALSPLG
NL/26/01   YPNEKDCETR GDHVFCDTAA GINVAEQSKE CNINISTTNY PCKVSTGRHP ISMVALSPLG
NL/28/01   YPNEKDCETR GDHVFCDTAA GINVAEQSKE CNINISTTNY PCKVSTGRHP ISMVALSPLG
NL/30/01   YPNEKDCETR GDHVFCDTAA GINVAEQSKE CNINISTTNY PCKVSTGRHP ISMVALSPLG
BR/2/01    YPNEKDCETR GDHVFCDTAA GINVAEQSKE CNINISTTNY PCKVSTGRHP ISMVALSPLG
BR/3/01    YPNEKDCETR GDHVFCDTAA GINVAEQSKE CNINISTTNY PCKVSTGRHP ISMVALSPLG
NL/2/02    YPNEKDCETR GDHVFCDTAA GINVAEQSKE CNINISTTNY PCKVSTGRHP ISMVALSPLG
NL/4/02    YPNEKDCETR GDHVFCDTAA GINVAEQSKE CNINISTTNY PCKVSTGRHP ISMVALSPLG
NL/5/02    YPNEKDCETR GDHVFCDTAA GINVAEQSKE CNINISTTNY PCKVSTGRHP ISMVALSPLG
NL/6/02    YPNEKDCETR GDHVFCDTAA GINVAEQSKE CNINISTTNY PCKVSTGRHP ISMVALSPLG
NL/7/02    YPNEKDCETR GDHVFCDTAA GINVAEQSKE CNINISTTNY PCKVSTGRHP ISMVALSPLG
NL/9/02    YPNEKDCETR GDHVFCDTAA GINVAEQSKE CNINISTTNY PCKVSTGRHP ISMVALSPLG
FL/1/02    YPNEKDCETR GDHVFCDTAA GINVAEQSKE CNINISTTNY PCKVSTGRHP ISMVALSPLG
NL/1/81    YPNEKDCETR GDHVFCDTAA GINVAEQSKE CNINISTTNY PCKVSTGRHP ISMVALSPLG
NL/1/93    YPNEKDCETR GDHVFCDTAA GINVAEQSKE CNINISTTNY PCKVSTGRHP ISMVALSPLG
NL/2/93    YPNEKDCETR GDHVFCDTVA GINVAEQSKE CNINISTTNY PCKVSTGRHP ISMVALSPLG
```

FIG.18B

```
NL/4/93     YPNEKDCETR GDHVFCDTAA GINVAEQSKE CNINISTTNY PCKVSTGRHP ISMVALSPLG
NL/1/95     YPNEKDCETR GDHVFCDTAA GINVAEQSKE CNINISTTNY PCKVSTGRHP ISMVALSPLG
NL/2/96     YPNEKDCETR GDHVFCDTAA GINVAEQSKE CNINISTTNY PCKVSTGRHP ISMVALSPLG
NL/3/96     YPNEKDCETR GDHVFCDTAA GINVAEQSKE CNINISTTNY PCKVSTGRHP ISMVALSPLG
NL/1/98     YPNEKDCETR GDHVFCDTAA GINVAEQSKE CNINISTTNY PCKVSTGRHP ISMVALSPLG
NL/17/00    YPNEKDCETR GDHVFCDTAA GINVAEQSKE CNINISTTNY PCKVSTGRHP ISMVALSPLG
NL/22/01    YPNEKDCETR GDHVFCDTAA GINVAEQSKE CNINISTTNY PCKVSTGRHP ISMVALSPLG
NL/29/01    YPNEKDCETR GDHVFCDTAA GINVAEQSKE CNINISTTNY PCKVSTGRHP ISMVALSPLG
NL/23/01    YPNEKDCETR GDHVFCDTAA GINVAEQSKE CNINISTTNY PCKVSTGRHP ISMVALSPLG
NL/17/01    YPNEKDCETR GDHVFCDTAA GINVAEQSKE CNINISTTNY PCKVSTGRHP ISMVALSPLG
NL/24/01    YPNEKDCETR GDHVFCDTAA GINVAEQSKE CNINISTTNY PCKVSTGRHP ISMVALSPLG
NL/3/02     YPNEKDCETR GDHVFCDTAA GINVAEQSKE CNINISTTNY PCKVSTGRHP ISMVALSPLG
NL/3/98     YPNEKDCETR GDHVFCDTAA GINVAEQSRE CNINISTTNY PCKVSTGRHP ISMVALSPLG
NL/1/99     YPNEKDCETR GDHVFCDTAA GINVAEQSRE CNINISTTNY PCKVSTGRHP ISMVALSPLG
NL/2/99     YPNEKDCETR GDHVFCDTAA GINVAEQSRE CNINISTTNY PCKVSTGRHP ISMVALSPLG
NL/3/99     YPNEKDCETR GDHVFCDTAA GINVAEQSRE CNINISTTNY PCKVSTGRHP ISMVALSPLG
NL/11/00    YPNEKDCETR GDHVFCDTAA GINVAEQSRE CNINISTTNY PCKVSTGRHP ISMVALSPLG
NL/12/00    YPNEKDCETR GDHVFCDTAA GINVAEQSRE CNINISTTNY PCKVSTGRHP ISMVALSPLG
NL/1/01     YPNEKDCETR GDHVFCDTAA GINVAEQSRE CNINISTTNY PCKVSTGRHP ISMVALSPLG
NL/5/01     YPNEKDCETR GDHVFCDTAA GINVAEQSRE CNINISTTNY PCKVSTGRHS ISMVALSPLG
NL/9/01     YPNEKDCETR GDHVFCDTAA GINVAEQSRE CNINISTTNY PCKVSTGRHP ISMVALSPLG
NL/19/01    YPNEKDCETR GDHVFCDTAA GINVAEQSRE CNINISTTNY PCKVSTGRHP ISMVALSPLG
NL/21/01    YPNEKDCETR GDHVFCDTAA GINVAEQSRE CNINISTTNY PCKVSTGRHP ISMVALSPLG
UK/11/01    YPNEKDCETR GDHVFCDTAA GINVAEQSRE CNINISTTNY PCKVSTGRHP ISMVALSPLG
FL/1/01     YPNEKDCETR GDHVFCDTAA GINVAEQSRE CNINISTTNY PCKVSTGRHP ISMVALSPLG
FL/2/01     YPNEKDCETR GDHVFCDTAA GINVAEQSRE CNINISTTNY PCKVSTGRHP ISMVALSPLG
FL/5/01     YPNEKDCETR GDHVFCDTAA GINVAEQSRE CNINISTTNY PCKVSTGRHP ISMVALSPLG
FL/7/01     YPNEKDCETR GDHVFCDTAA GINVAEQSRE CNINISTTNY PCKVSTGRHP ISMVALSPLG
FL/9/01     YPNEKDCETR GDHVFCDTAA GINVAEQSRE CNINISTTNY PCKVSTGRHP ISMVALSPLG
UK/10/01    YPNEKDCETR GDHVFCDTAA GINVAEQSRE CNINISTTNY PCKVSTGRHP ISMVALSPLG
NL/1/02     YPNEKDCETR GDHVFCDTAÁ GINVAEQSRE CNINISTTNY PCKVSTGRHP ISMVALSPLG
NL/1/94     YPNEKDCETR GDHVFCDTAA GINVAEQSRE CNINISTTNY PCKVSTGRHP ISMVALSPLG
NL/1/96     YPNEKDCETR GDHVFCDTAA GINVAEQSRE CNINISTTNY PCKVSTGRHP ISMVALSPLG
NL/6/97     YPNEKDCETR GDHVFCDTAA GINVAEQSRE CNINISTTNY PCKVSTGRHP ISMVALSPLG
NL/7/00     YPNEKDCETR GDHVFCDTAA GINVAEQSRE CNINISTTNY PCKVSTGRHP ISMVALSPLG
NL/9/00     YPNEKDCETR GDHVFCDTAA GINVAEQSRE CNINISTTNY PCKVSTGRHP ISMVALSPLG
NL/19/00    YPNEKDCETR GDHVFCDTAA GINVAEQSRE CNINISTTNY PCKVSTGRHP ISMVALSPLG
NL/28/00    YPNEKDCETR GDHVFCDTAA GINVAEQSRE CNINISTTNY PCKVSTGRHP ISMVALSPLG
NL/3/01     YPNEKDCETR GDHVFCDTAA GINVAEQSRE CNINISTTNY PCKVSTGRHP ISMVALSPLG
NL/4/01     YPNEKDCETR GDHVFCDTAA GINVAEQSRE CNINISTTNY PCKVSTGRHP ISMVALSPLG
NL/11/01    YPNEKDCETR GDHVFCDTAA GINVAEQSRE CNINISTTNY PCKVSTGRHP ISMVALSPLG
NL/15/01    YPNEKDCETR GDHVFCDTAA GINVAEQSRE CNINISTTNY PCKVSTGRHP ISMVALSPLG
NL/18/01    YPNEKDCETR GDHVFCDTAA GINVAEQSRE CNINISTTNY PCKVSTGRHP ISMVALSPLG
FL/6/01     YPNEKDCETR GDHVFCDTAA GINVAEQSRE CNINISTTNY PCKVSTGRHP ISMVALSPLG
UK/5/01     YPNEKDCETR GDHVFCDTAA GINVAEQSRE CNINISTTNY PCKVSTGRHP ISMVALSPLG
UK/8/01     YPNEKDCETR GDHVFCDTAA GINVAEQSRE CNINISTTNY PCKVSTGRHP ISMVALSPLG
NL/12/02    YPNEKDCETR GDHVFCDTAA GINVAEQSRE CNINISTTNY PCKVSTGRHP ISMVALSPLG
HK/1/02     YPNEKDCETR GDHVFCDTAA GINVAEQSRE CNINISTTNY PCKVSTGRHP ISMVALSPLG

....|....| ....|....| ....|....
               125        135        145
NL/1/00     ALVACYKGVS CSIGSNRVGI IKQLNKGCS
UK/1/00     ALVACYKGVS CSIGSNRVGI IKQLNKGCS
NL/2/00     ALVACYKGVS CSIGSNRVGI IKQLNKGCS
NL/13/00    ALVACYKGVS CSIGSNRVGI IKQLNKGCS
NL/14/00    ALVACYKGVS CSIGSNRVGI IKQLNKGCS
FL/3/01     ALVACYKGVS CSIGSNRVGI IKQLNKGCS
FL/4/01     ALVACYKGVS CSIGSNRVGI IKQLNKGCS
FL/8/01     ALVACYKGVS CSIGSNRVGI IKQLNKGCS
UK/1/01     ALVACYKGVS CSIGSNRVGI IKQLNKGCS
UK/7/01     ALVACYKGVS CSIGSNRVGI IKQLNKGCS
```

FIG.18C

| | |
|---|---|
| FL/10/01 | ALVACYKGVS CSIGSNRVGI IKQLNKGCS |
| NL/6/01 | ALVACYKGVS CSIGSNRVGI IKQLNKGCS |
| NL/8/01 | ALVACYKGVS CSIGSNRVGI IKQLNKGCS |
| NL/10/01 | ALVACYKGVS CSIGSNRVGI IKQLNKGCS |
| NL/14/01 | ALVACYKGVS CSIGSNRVGI IKQLNKGCS |
| NL/20/01 | ALVACYKGVS CSIGSNRVGI IKQLNKGCS |
| NL/25/01 | ALVACYKGVS CSIGSNRVGI IKQLNKGCS |
| NL/26/01 | ALVACYKGVS CSIGSNRVGI IKQLNKGCS |
| NL/28/01 | ALVACYKGVS CSIGSNRVGI IKQLNKGCS |
| NL/30/01 | ALVACYKGVS CSIGSNRVGI IKQLNKGCS |
| BR/2/01 | ALVACYKGVS CSIGSNRVGI IKQLNKGCS |
| BR/3/01 | ALVACYKGVS CSIGSNRVGI IKQLNKGCS |
| NL/2/02 | ALVACYKGVS CSIGSNRVGI IKQLNKGCS |
| NL/4/02 | ALVACYKGVS CSIGSNRVGI IKQLNKGCS |
| NL/5/02 | ALVACYKGVS CSIGSNRVGI IKQLNKGCS |
| NL/6/02 | ALVACYKGVS CSIGSNRVGI IKQLNKGCS |
| NL/7/02 | ALVACYKGVS CSIGSNRVGI IKQLNKGCS |
| NL/9/02 | ALVACYKGVS CSIGSNRVGI IKQLNKGCS |
| FL/1/02 | ALVACYKGVS CSIGSNRVGI IKQLNKGCS |
| NL/1/81 | ALVACYKGVS CSIGSNRVGI IKQLNKGCS |
| NL/1/93 | ALVACYKGVS CSIGSNRVGI IKQLNKGCS |
| NL/2/93 | ALVACYKGVS CSIGSNRVGI IKQLNKGCS |
| NL/4/93 | ALVACYKGVS CSIGSNRVGI IKQLNKGCS |
| NL/1/95 | ALVACYKGVS CSIGSNRVGI IKQLNKGCS |
| NL/2/96 | ALVACYKGVS CSIGSNRVGI IKQLNKGCS |
| NL/3/96 | ALVACYKGVS CSIGSNRVGI IKQLNKGCS |
| NL/1/98 | ALVACYKGVS CSIGSNRVGI IKQLNKGCS |
| NL/17/00 | ALVACYKGVS CSIGSNRVGI IKQLNKGCS |
| NL/22/01 | ALVACYKGVS CSIGSNRVGI IKQLNKGCS |
| NL/29/01 | ALVACYKGVS CSIGSNRVGI IKQLNKGCS |
| NL/23/01 | ALVACYKGVS CSIGSNRVGI IKQLNKGCS |
| NL/17/01 | ALVACYKGVS CSIGSNRVGI IKQLNKGCS |
| NL/24/01 | ALVACYKGVS CSIGSNRVGI IKQLNKGCS |
| NL/3/02 | ALVACYKGVS CSIGSNRVGI IKQLNKGCS |
| NL/3/98 | ALVACYKGVS CSIGSNRVGI IKQLPKGCS |
| NL/1/99 | ALVACYKGVS CSIGSNWVGI IKQLPKGCS |
| NL/2/99 | ALVACYKGVS CSIGSNRVGI IKQLPKGCS |
| NL/3/99 | ALVACYKGVS CSIGSNRVGI IKQLPKGCS |
| NL/11/00 | ALVACYKGVS CSIGSNRVGI IKQLPKGCS |
| NL/12/00 | ALVACYKGVS CSIGSNRVGI IKQLPKGCS |
| NL/1/01 | ALVACYKGVS CSIGSNRVGI IKQLPKGCS |
| NL/5/01 | ALVACYKGVS CSIGSNRVGI IKQLPKGCS |
| NL/9/01 | ALVACYKGVS CSIGSNRVGI IKQLPKGCS |
| NL/19/01 | ALVACYKGVS CSIGSNRVGI IKQLPKGCS |
| NL/21/01 | ALVACYKGVS CSIGSNRVGI IKQLPKGCS |
| UK/11/01 | ALVACYKGVS CSIGSNRVGI IKQLPKGCS |
| FL/1/01 | ALVACYKGVS CSIGSNRVGI IKQLPKGCS |
| FL/2/01 | ALVACYKGVS CSIGSNRVGI IKQLPKGCS |
| FL/5/01 | ALVACYKGVS CSIGSNRVGI IKQLPKGCS |
| FL/7/01 | ALVACYKGVS CSIGSNRVGI IKQLPKGCS |
| FL/9/01 | ALVACYKGVS CSIGSNRVGI IKQLPKGCS |
| UK/10/01 | ALVACYKGVS CSIGSNRVGI IKQLPKGCS |
| NL/1/02 | ALVACYKGVS CSIGSNRVGI IKQLPKGCS |
| NL/1/94 | ALVACYKGVS CSIGSNRVGI IKQLPKGCS |
| NL/1/96 | ALVACYKGVS CSIGSNRVGI IKQLPKGCS |
| NL/6/97 | ALVACYKGVS CSIGSNRVGI IKQLPKGCS |
| NL/7/00 | ALVACYKGVS CSIGSNRVGI IKQLPKGCS |
| NL/9/00 | ALVACYKGVS CSIGSNRVGI IKQLPKGCS |
| NL/19/00 | ALVACYKGVS CSIGSNRVGI IKQLPKGCS |
| NL/28/00 | ALVACYKGVS CSIGSNRVGI IKQLPKGCS |
| NL/3/01 | ALVACYKGVS CSIGSNRVGI IKQLPKGCS |

FIG. 18D

```
NL/4/01      ALVACYKGVS  CSIGSNRVGI  IKQLPKGCS
NL/11/01     ALVACYKGVS  CSIGSNRVGI  IKQLPKGCS
NL/15/01     ALVACYKGVS  CSIGSNRVGI  IKQLPKGCS
NL/18/01     ALVACYKGVS  CSIGSNRVGI  IKQLPKGCS
FL/6/01      ALVACYKGVS  CSIGSNRVGI  IKQLPKGCS
UK/5/01      ALVACYKGVS  CSIGSNRVGI  IKQLPKGCS
UK/8/01      ALVACYKGVS  CSIGSNRVGI  IKQLPKGCS
NL/12/02     ALVACYKGVS  CSIGSNRVGI  IKQLPKGCS
HK/1/02      ALVACYKGVS  CSIGSNRVGI  IKQLPKGCS
```

FIG.18E

Alignment: G DNA

```
                        ....|....|  ....|....|  ....|....|  ....|....|  ....|....|  ....|....|
                            5           15          25          35          45          55
NL/1/00  (p   ATGGAGGTGA AAGTGGAGAA CATTCGAACA ATAGATATGC TCAAAGCAAG AGTAAAAAAT
BR/2/01  (A   ATGGAGGTGA AAGTGGAGAA CATTCGAACA ATAGATATGC TCAAAGCAAG TGTAAAAAAT
FL/4/01  (A   ATGGAGGTGA AAGTGGAGAA CATTCGAACA ATAGATATGC TCAAAGCAAG AGTAAAAAAT
FL/3/01  (A   ATGGAGGTGA AAGTGGAGAA CATTCGAACA ATAGATATGC TCAAAGCAAG AGTAAAAAAT
FL/8/01  (A   ATGGAGGTGA AAGTGGAGAA CATTCGAACA ATAGATATGC TCAAAGCAAG AGTAAAAAAT
FL/10/01 (    ATGGAGGTGA AAGTGGAGAA CATTCGAACA ATAGATATGC TCAAAGCAAG AGTGAAAAAT
NL/10/01 (    ATGGAGGTGA AAGTGGAGAA CATTCGAACA ATAGATATGC TCAAAGCAAG AGTGAAAAAT
NL/2/02  (A   ATGGAGGTGA AAGTGGAGAA CATTCGAACA ATAGATATGC TCAAAGCAAG AGTGAAAAAT
NL/17/00 (    ATGGAGGTGA AAGTAGAGAA CATTCGAGCA ATAGACATGC TCAAAGCAAG AGTGAAAAAT
NL/1/81  (A   ATGGAGGTGA AAGTAGAGAA CATTCGAGCA ATAGACATGC TCAAAGCAAG AGTGAAAAAT
NL/1/93  (A   ATGGAGGTGA AAGTAGAGAA CATCCGAGCA GTAGACATGC TCAAAGCAAG AGTCAAAAAT
NL/2/93  (A   ATGGAGGTGA AAGTAGAGAA CATCCGAGCA GTAGACATGC TCAAAGCAAG AGTTAAAAAT
NL/3/93  (A   ATGGAGGTGA AAGTAGAGAA CATTCGAGCA ATAGACATGC TCAAAGCAAG AATGAAAAAT
NL/1/95  (A   ATGGAGGTGA AAGTAGAGAA CATTCGAGCA ATAGACATGC TCAAAGCAAG AGTGAAAAAT
NL/2/96  (A   ATGGAGGTGA AAGTAGAGAA CATTCGAGCA ATAGACATGC TCAAAGCAAG AGTGAAAAAT
NL/3/96  (A   ATGGAGGTGA AAGTAGAGAA CATTCGAGCA ATAGACATGC TCAAAGCAAG AGTGAAAAAT
NL/22/01 (    ATGGAGGTGA AAGTAGAGAA CATTCGAGCA ATAGACATGC TCAAAGCAAG AGTGAAAAAT
NL/24/01 (    ATGGAGGTGA AAGTAGAGAA CATTCGAGCA ATAGACATGC TCAAAGCAAG AGTGAAAAAT
NL/23/01 (    ATGGAGGTGA AAGTAGAGAA TATTCGAGCA ATAGACATGC TCAAAGCAAG AGTGAAAAAT
NL/29/01 (    ATGGAGGTGA AAGTAGAGAA CATTCGAGCA ATAGACATGC TCAAAGCAAG AGTGAAAAAT
NL/3/02  (A   ATGGAGGTGA AAGTAGAGAA CATTCGAGCA ATAGACATGC TCAAAGCAAG AGTGAAAAAT
NL/1/99  (p   ATGGAAGTAA GAGTGGAGAA CATTCGAGCG ATAGACATGT TCAAAGCAAA GATAAAAAAC
NL/11/00 (    ATGGAAGTAA GAGTGGAGAA CATTCGAGCG ATAGACATGT TCAAAGCAAA GATAAAGAAC
NL/12/00 (    ATGGAAGTAA GAGTGGAGAA CATTCGAGCG ATAGACATGT TCAAAGCAAA GATAAAAAAC
NL/5/01  (B   ATGGAAGTAA GAGTGGAGAA CATTCGAGCG ATAGACATGT TCAAAGCAAA GATAAAAAAC
NL/9/01  (B   ATGGAAGTAA GAGTGGAGAA CATTCGAGCG ATAGACATGT TCAAAGCAAA GATAAAAAAC
NL/21/01 (    ATGGAAGTAA GAGTGGAGAA CATTCGAGCG ATAGACATGT TCAAAGCAAA GATAAAAAAC
NL/1/94  (p   ATGGAAGTAA GAGTGGAGAA CATTCGGGCA ATAGACATGT TCAAAGCAAA AATGAAAAAC
NL/1/82  (B   ATGGAAGTAA GAGTGGAGAA CATTCGGACA ATAGACATGT TCAAAGCAAA GATGAAAAAC
NL/1/96  (B   ATGGAAGTAA GAGTGGAGAA CATTCGGGCA ATAGACATGT TCAAAGCAAA GATGAAAAAC
NL/6/97  (B   ATGGAAGTAA GAGTGGAGAA CATTCGGGCA ATAGACATGT TCAAAGCAAA GATGAAAAAC
NL/9/00  (B   ATGGAAGTAA GAGTGGAGAA CATTCGGGCA ATAGACATGT TCAAAGCAAA GATGAAAAAC
NL/3/01  (B   ATGGAAGTAA GAGTGGAGAA CATTCGGGCA ATAGACATGT TCAAAGCAAA GATGAAAAAC
NL/4/01  (B   ATGGAAGTAA GAGTGGAGAA CATTCGGGCA ATAGACATGT TCAAAGCAAA GATGAAAAAC
UK/5/01  (B   ATGGAAGTAA GAGTGGAGAA CATTCGGGCA ATAGACATGT TCAAAGCAAA GATGAAAAAC

....|....|  ....|....|  ....|....|  ....|....|  ....|....|  ....|....|
                            65          75          85          95         105         115
NL/1/00  (p   CGTGTGGCAC GCAGCAAATG CTTTAAAAAT GCCTCTTTGG TCCTCATAGG AATAACTACA
BR/2/01  (A   CGTGTGGCAC GCAGCAAATG CTTTAAAAAT GCCTCTTTGG TCCTCATAGG AATAACTACA
FL/4/01  (A   CGTGTGGCAC GCAGCAAATG CTTTAAAAAT GCCTCTTTGG TCCTCATAGG AATAACTACA
FL/3/01  (A   CGTGTGGCAC GCAGCAAATG CTTTAAAAAT GCCTCTTTGG TCCTCATAGG AATAACTACA
FL/8/01  (A   CGTGTGGCAC GCAGCAAATG CTTTAAAAAT GCCTCTTTGG TCCTCATAGG AATAACTACA
FL/10/01 (    CGTGTGGCAC GCAGCAAATG CTTTAAAAAT GCCTCTTTGA TCCTAATAGG AATAACTACA
NL/10/01 (    CGTGTGGCAC GCAGCAAATG CTTTAAAAAT GCCTCTTTGA TCCTAATAGG AATAACTACA
NL/2/02  (A   CGTGTGGCAC GCAGCAAATG CTTTAAAAAT GCCTCTTTGA TCCTAATAGG AATAACTACA
NL/17/00 (    CGTGTGGCAC GTAGCAAATG CTTTAAAAAT GCTTCTTTAA TCCTCATAGG AATAACTACA
NL/1/81  (A   CGTGTGGCAC GCAGCAAATG CTTTAAAAAT GCTTCTTTAA TCCTCATAGG AATAACTACA
NL/1/93  (A   CGTGTGGCAC GCAGCAAATG CTTTAAAAAT GCCTCCTTAA TCCTCGTAGG AATAACTACA
NL/2/93  (A   CGTGTGGCAC GCAGCAAATG CTTTAAAAAT GCCTCTTTAA TCCTCGTAGG AATAACTACA
NL/3/93  (A   CGTGTGGCAC GCAGCAAATG CTTTAAAAAT GCTTCTTTAA TCCTCATAGG AATAACTACT
NL/1/95  (A   CGTGTGGCAC GCAGCAAATG CTTTAAAAAT GCTTCTTTAA TCCTCATAGG AATAACTACT
NL/2/96  (A   CGTGTGGCAC GTAGCAAATG CTTTAAAAAT GCTTCTTTAA TCCTCATAGG AATAACTACA
NL/3/96  (A   CGTGTGGCAC GCAGCAAATG CTTTAAAAAT GCTTCTTTAA TCCTCATAGG AATAACTACT
NL/22/01 (    CGTGTGGCAC GCAGCAAATG CTTTAAAAAT GCTTCTTTAA TCCTCATAGG AATAACTACT
```

FIG.19A

```
NL/24/01 (    CGTGTGGCAC GCAGCAAATG CTTTAAAAAT GCTTCTTTAA TCCTCATAGG AATAACTACT
NL/23/01 (    CGTGTGGCAC GCAGCAAATG CTTTAAAAAT GCTTCTTTAA TCCTCATAGG AATAACTACT
NL/29/01 (    CGTGTGGCAC GTAGCAAATG CTTTAAAAAT GCTTCTTTAA TCCTCATAGG AATAACTACA
NL/3/02 (A    CGTGTGGCAC GTAGCAAATG CTTTAAAAAT GCTTCTTTAA TCCTCATAGG AATAACTACA
NL/1/99 (p    CGTATAAGAA GCAGCAGGTG CTATAGAAAT GCTACACTGA TCCTTATTGG ACTAACAGCG
NL/11/00 (    CGTATAAGAA GCAGCAGGTG CTATAGAAAT GCTACACTGA TCCTTATTGG ACTAACAGCG
NL/12/00 (    CGTATAAGAA GCAGCAGGTG CTATAGAAAT GCTACACTGA TCCTTATTGG ACTAACAGCG
NL/5/01 (B    CGTATAAGAA GCAGCAGGTG CTATAGAAAT GCTACACTGA TCCTTATTGG ACTAACAGCG
NL/9/01 (B    CGTATAAGAA GCAGCAGGTG CTATAGAAAT GCTACATTGA TCCTTATTGG ACTAACAGCG
NL/21/01 (    CGTATAAGAA GCAGCAGGTG CTATAGAAAT GCTACACTGA TCCTTATTGG ACTAACAGCG
NL/1/94 (p    CGTATAAGAA GTAGCAAGTG CTATAGAAAT GCTACACTGA TCCTTATTGG ATTAACAGCA
NL/1/82 (B    CGTATAAGAA GCAGCAAGTG CTATAGAAAT GCTACACTGA TCCTTATTGG ACTGACAGCA
NL/1/96 (B    CGTATAAGAA GTAGCAAGTG CTATAGAAAT GCTACACTGA TCCTTATTGG ATTAACAGCA
NL/6/97 (B    CGCATAAGAA GTAGCAAGTG CTATAGAAAT GCTACACTGA TCCTTATTGG ATTAACAGCA
NL/9/00 (B    CGTATAAGAA GTAGCAAGTG CTATAGAAAT GCTACACTGA TCCTTATTGG ATTAACAGCA
NL/3/01 (B    CGTATAAGAA GTAGCAAGTG CTATAGAAAT GCTACACTGA TCCTTATTGG ATTATCAGCA
NL/4/01 (B    CGTATAAGAA GTAGCAAGTG CTATAGAAAT GCTACACTGA TCCTTATTGG ATTATCAGCA
UK/5/01 (B    CGTATAAGAA GTAGCAAGTG CTATAGAAAT GCTACACTGA TCCTTATTGG ATTAACAGCA

....|....| ....|....| ....|....| ....|....| ....|....| ....|....|
                    125        135        145        155        165        175
NL/1/00 (p    TTGAGTATTG CCCTCAATAT CTATCTGATC ATAAACTATA AAATGCAAAA AAACACATCT
BR/2/01 (A    TTGAGTATTG CCCTCAATAT CTATCTGATC ATAAACTATA AAATGCAAAA AAACACATCT
FL/4/01 (A    CTGAGTATTG CCCTCAATAT CTATCTGATC ATAAACTATA AAATGCAAAA AAACACATCT
FL/3/01 (A    TTGAGTATTG CCCTCAATAT CTATCTGATC ATAAACTATA AAATGCAAAA AAACACATCT
FL/8/01 (A    TTGAGTATTG CCCTCAATAT CTATCTGATC ATAAACTATA AAATGCAAAA AAACACATCT
FL/10/01 (    TTGAGTATTG CCCTCAATAT CTATCTGATC ATAAACTATA CAATGCAAGA AAACACATCC
NL/10/01 (    TTGAGTATAG CCCTCAATAT CTATCTGATC ATAAACTATA CAATGCAAGA AAACACATCC
NL/2/02 (A    TTGAGTATAG CCCTCAATAT CTATCTGATC ATAAACTATA CAATGCAAGA AAACACATCC
NL/17/00 (    CTGAGTATAG CTCTCAATAT CTATCTGATC ATAAACTACA CAATACAAAA AACCACATCC
NL/1/81 (A    CTGAGTATAG CCCTCAATAT CTATCTGATC ATAAACTACA CAATACAAAA AACCACATCT
NL/1/93 (A    CTGAGCATAG CCCTCAATAT CTATCTGATC GTAAACTACA CAATACAAAA AACCACATCC
NL/2/93 (A    CTGAGTATAG CCCTCAATAT CTATCTGATC GTAAACTACA CAATACAAAA AACCACATCC
NL/3/93 (A    CTGAGTATAG CCCTCAATAT CTATCTGATC ATAAACTACA CAATACAAAA AACCACATCT
NL/1/95 (A    CTGAGTATAG CCCTCAACAT CTATCTGATC ATAAACTACA CAATACAAAA AACCACATCT
NL/2/96 (A    CTGAGTATAG CTCTCAATAT CTATCTGATC ATAAACTACA CAATACAAAA AACCACATCT
NL/3/96 (A    CTGAGTATAG CCCTCAACAT CTATCTGATC ATAAACTACA CAATACAAAA AACCACATCT
NL/22/01 (    CTGAGTATAG CCCTCAATAT CTATCTGATC ATAAACTACA CAATACAAAA AACCACATCT
NL/24/01 (    CTGAGTATAG CCCTCAATAT CTATCTGATC ATAAACTACA CAATACAAAA AACCACATCT
NL/23/01 (    CTGAGTATAG CCCTCAATAT CTATCTGATC ATAAACTACA CAATACAAAA AACCACATCT
NL/29/01 (    CTGAGCATAG CCCTCAATAT CTATCTGATC ATAAACTACA CAATACAACA AACCACATCT
NL/3/02 (A    CTGAGCATAG CCCTCAATAT CTATCTGATC ATAAACTACA CAATACAAAA AACCACATCT
NL/1/99 (p    TTAAGCATGG CACTTAATAT TTTCCTGATC ATCGATCATG CAACATTAAG AAACATGATC
NL/11/00 (    TTAAGCATGG CACTTAATAT TTTCCTGATC ATTGATCATG CAACATTAAG AAACATGATC
NL/12/00 (    TTAAGCATGG CACTTAATAT TTTCCTGATC ATCGATCATG CAACATTAAG AAACATGATC
NL/5/01 (B    TTAAGCATGG CACTTAATAT TTTCCTGATC ATCGATCATG CAACATTAAG AAACATGATC
NL/9/01 (B    TTAAGCATGG CACTTAATAT TTTCCTGATC ATCGATCATG CAACATTAAG AAACATGATC
NL/21/01 (    TTAAGCATGG CACTTAATAT TTTCCTGATC ATCGATCATG CAACATTAAG AAACATGATC
NL/1/94 (p    TTAAGTATGG CACTTAATAT TTTTTTAATC ATTGATTATG CAATGTTAAA AAACATGACC
NL/1/82 (B    TTAAGTATGG CACTTAATAT TTTCTTGATC ATCGATTATG CAACATTTAA AAACATGACC
NL/1/96 (B    TTAAGTATGG CACTTAATAT TTTTTTAATC ATTGATTATG CAATGTTAAA AAACATGACC
NL/6/97 (B    TTAAGTATGG CACTTAATAT TTTTTTAATC ATTGATTATG CAACATTAAA AAACATGACC
NL/9/00 (B    CTAAGTATGG CACTTAATAT TTTTTTAATC ATTGATTATG CAACATTAAA AAACATGACC
NL/3/01 (B    CTAAGTATGG CACTTAATAT TTTTTTAATC ATTGATTATG CAAAATCAAA AAACATGACC
NL/4/01 (B    CTAAGTATGG CACTTAATAT TTTTTTAATC ATTGATTATG CAAAATCAAA AACCATGACC
UK/5/01 (B    CTAAGTATGG CACTTAATAT TTTTTTAATC ATTGATTATG CAACATTAAA AAACATGACC

....|....| ....|....| ....|....| ....|....| ....|....| ....|....|
                    185        195        205        215        225        235
NL/1/00 (p    GAATCAGAAC ATCACACCAG CTCATCACCC ATGGAATCCA GCAGAGAAAC TCCAACGGTC
BR/2/01 (A    GAATCAGAAC ATCACACCAG CTCATCACCC ATGGAATCCA GCAGAGAAAC TCCAACGGTC
```

FIG. 19B

```
FL/4/01  (A  GAATCAGAAC ATCACACCAG CTCATCACCC ATGGAATCCA GCAGAGAAAC TCCAACGGTC
FL/3/01  (A  GAATCAGAAC ATCACACCAG CTCATCACCC ATGGAATCCA GCAGAGAAAC TCCAACGGTC
FL/8/01  (A  GAATCAGAAC ATCACACCAG CTCATCACCC ATGGAATCCA GCAGAGAAAC TCCAACGGTC
FL/10/01 (   GAATCAGAAC ATCACACCAG CTCATCACCC ATGGAATCCA GCAGGGAAAC TCCAACGGTC
NL/10/01 (   GAATCAGAAC ATCACACCAG TTCATCACCC ATGGAATCCA GCAGGGAAAC TCCAACGGTC
NL/2/02  (A  GAATCAGAAC ATCACACCAG CTCATCACCC ATGGAATCCA GCAGAGAAAC TCCAACGGTC
NL/17/00 (   GAATCAGAAC ACCACACCAG CTCACCACCC ACAGAACCCA ACAAGGAAGC TTCAACAATC
NL/1/81  (A  GAATCAGAAC ACCACACTAG CTCACCACCC ACAGAATCCA ACAAAGAAAC TTCAACAATC
NL/1/93  (A  GAATCAGAAC ACCACACCAG CTCATCACCC ACAGAATCCA ACAAAGGAAC TTCAACAATC
NL/2/93  (A  GAATCAGAAC ACCACACTAG CTCATCACCC ACAGAATCCA ACAAAGGAAC TTCAACAATC
NL/3/93  (A  GAATCAGAAC ACCACACCAG CTCACCACCC ACAGAATCCA ACAAAGAAAC TTCAACAATC
NL/1/95  (A  GAATCAGAAC ACCACACTAG CTCACCACCC ACAGAATCCA ACAAAGAAAC TTCAACAATC
NL/2/96  (A  GAATCAGAAC ACCACACCAG CTCACCACCC ACAGAATCCA ACAAGGAAGC TTCAACAATC
NL/3/96  (A  GAATCAGAAC ACCACACTAG CTCACCACCC ACAGAATCTA ACAAAGAAAC TTCAACAATC
NL/22/01 (   GAATCAGAAC ACCACACTAG CTCACCACCC ACAGAATCTA ACAAGGAAAC TTCAACAATC
NL/24/01 (   GAATCAGAAC ACCACACTAG CTCACCACCC ACAGAATCTA ACAAGGAAAC TTCAACAATC
NL/23/01 (   GAATCAGAAC ACCACACTAG CTCACCACCC ACAGAATCTA ACAAGGAAAC TTCAACAATC
NL/29/01 (   GAATCAGAAC ACCACACCAG CTCACCACCC ACAGAATCCA ACAAGGAAGC TTCAACAATC
NL/3/02  (A  GAATCAGAAC ACCACACCAG CTCACCACCC ACAGAATCCA ACAAGGAAGC TTCAACAATC
NL/1/99  (p  AAAACAGAAA ACTGTGCTAA CATGCCGTCG GCAGAACCAA GCAAAAAGAC CCCAATGACC
NL/11/00 (   AAAACAGAAA ACTGTGCTAA CATGCCATCG GCAGAACCAA GCAAAAAGAC CCCAATGACC
NL/12/00 (   AAAACAGAAA ATTGTGCTAA CATGCCGCCG GCAGAACCAA GCAAAAAGAC CCCAATGACC
NL/5/01  (B  AAAACAGAAA ATTGTGCTAA CATGCCGCCG GCAGAACCAA GCAGAAAGAC CCCAATGACC
NL/9/01  (B  AAAACAGAAA ATTGTGCTAA CATGCCGCCG GCAGAACCAA GCAAAAAGAC CCCAATGACC
NL/21/01 (   AAAACAGAAA ATTGTGCTAA CATGCCGCCG GCAGAACCAA GCAAAAAGAC CCCAATGACC
NL/1/94  (p  AAAGTGGAAC ACTGTGTTAA TATGCCGCCG GTAGAACCAA GCAAGAAGAC CCCAATGACC
NL/1/82  (B  AAAGTGGAAC ACTGTGCTAA TATGCCGCCG GTAGAACCGA GTAAGAAGAC CCCAATGACC
NL/1/96  (B  AAAGTGGAAC ACTGTGTTAA TATGCCGCCG GTAGAACCAA GCAAGAAGAC CCCAATGACC
NL/6/97  (B  AAAGTGGAAC ACTGTGTTAA TATGCCGCCG GTAGAACCAA GCAAGAAGAC CCCAATGACC
NL/9/00  (B  AAAGTGGAAC ACTGTGTTAA TATGCCGCCG GTAGAACCAA GCAAGAAGAC CCCAATGACC
NL/3/01  (B  AGAGTGGAAC ACTGTGTCAA TATGCCGCCG GTAGAACCAA GCAAGAAGAC CCCAATGACC
NL/4/01  (B  AGAGTGGAAC ACTGTGTTAA TATGCCGCCG GTAGAACCAA GCAAGAAGAC CCCAATGACC
UK/5/01  (B  AAAGTGGAAC ACTGTGTTAA TATGCCGCCG GTAGAACCAA GCAAGAAGAC CCCAATGACC

....|....| ....|....| ....|....| ....|....| ....|....| ....|....|
                 245        255        265        275        285        295
NL/1/00  (p  CCCACAGACA ACTCAGACAC CAACTCAAGC CCACAGCATC CAACTCAACA GTCCACAGAA
BR/2/01  (A  CCCACAGACA ACTCAGACAC CAACTCAAGC CCACAGCATC CAACTCAACA GTCCACAGAA
FL/4/01  (A  CCCACAGATA ATTCAGACAC CAACTCAAGC CCACAACATC CAACTCAACA GTCCACAGAA
FL/3/01  (A  CCCACAGATA ATTCAGACAC CAACTCAAGC CCACAACATC CAACTCAACA GTCCACAGAA
FL/8/01  (A  CCCACAGATA ATTCAGACAC CAACTCAAGC CCACAACATC CAACTCAACA GTCCACAGAA
FL/10/01 (   CCCATAGACA ACTCAGACAC CAATCCAGTC TCACAGTATC CAACTCAACA GTCCACAGAA
NL/10/01 (   CCTATGGACA ACTCAGACAC CAATCCAGGC TCACAGTATC CAACTCAACA GTCCACAGAA
NL/2/02  (A  CCTATGGACA ACTCAGACAC CAATCCAGGC TCACAGTATC CAACTCAACA GTCCACAGAA
NL/17/00 (   TCCACAGACA ACCCAGACAT CAATCCAAGC TCACAGCATC CAACTCAACA GTCCACAGAA
NL/1/81  (A  CCCATAGACA ACCCAGACAT CAATCCAAAC TCACAGCATC CAACCCAACA GTCCACAGAA
NL/1/93  (A  CCCACAGACA ACCCAGACAT CAATCCAAAT TCACAACATC CAACTCAACA GTCCACAGAA
NL/2/93  (A  CC-ACAGACA ACCCAGACAT CAATCCAAAT TCACAACATC CAACTCAACA GTCCACAGAA
NL/3/93  (A  CCTATAGACA ACCCAGACAT CAATCCAAAC TCACAACATC CAACTCAACA GTCCACAGAA
NL/1/95  (A  TCTATAGACA ACCCAGACAT CAATCCAAAC TCACAGCATC CAACTCAACA GTCCACAGAA
NL/2/96  (A  TCCACAGACA ATCCAGACAT CAATCCAAAC TCACAGCATC CAACTCAACA GTCCACAGAA
NL/3/96  (A  TCTATAGACA ACTCAGACAT CAATCCAAAC TCACAGCATC CAACTCAACA GTCCACAGAA
NL/22/01 (   CCTATAGACA ACCCAGACAT CAATCCAAAC TCACAGCATC CAACTCAACA GTCCACAGAA
NL/24/01 (   CCTATAGACA ACCCAGACAT CAATCCAAAC TCACAGCATC CAACTCAACA GTCCGCAGAA
NL/23/01 (   CCTATAGACA ACCCAGACAT CAATCCAAAC TCACAGCATC CAACTCAACA GTCCACAGAA
NL/29/01 (   TCCACAGACA ACCCAGACAT CAATCCAAAC TCACAGCATC CAACTCAACA GTCCACAGAA
NL/3/02  (A  TCCACAGACA ACCCAGACAT CAATCCAAAC TCACAGCATC CAACTCAACA GTCCACAGAA
NL/1/99  (p  TCCACAGCAG GCCCAAACAC CAAACCCAAT CCACAGCAAG CAACACAGTG GACCACAGAG
NL/11/00 (   TCCACAGCAG GCCCAAGCAC CGAACCCAAT CCACAGCAAG CAACACAATG GACCACAGAG
NL/12/00 (   TCTACAGCAG GCCCAAACAC CAAACCCAAT CCACAGCAAG CAACACAGTG GACCACGGAG
NL/5/01  (B  TCCACAGCAG GCCCAAACAC CAAACCCAAT CCACAGCAAG CAACACAGTG GACCACGGAG
```

FIG.19C

```
NL/9/01  (B   TCCACAGCAG GCCTAAACAC TAAACCCAAT CCACAGCAAG CAACACAGTG GACCACGGAG
NL/21/01 (    TCCACAGCAG GCCCAAACAC CAAACCCAAT CCACAGCAAG CAACACAGTG GACCACGGAG
NL/1/94  (p   TCTGCAGTAG ACTTAAACAC CAAACCCAAT CCACAGCAGG CAACACAGTT GGCCGCAGAG
NL/1/82  (B   TCTACAGTAG ACTCAAGCAC CGGACCCAAT CCACAGCAGA CAACACAGTG GACCACAGAG
NL/1/96  (B   TCTGCAGTAG ACTTAAACAC CAAACTCAAT CCACAGCAGG CAACACAGTT GACCACAGAG
NL/6/97  (B   TCTGCAGTAG ACTTAAACAC CAAACTCAAT CCACAGCAGG CAACACAGTT GACCACAGAG
NL/9/00  (B   TCTGCAGTAG ACTCAAACAC CAAACCCAAT CCACAGCAGG CAACACAGTT GACCACAGAG
NL/3/01  (B   TCTGCAGTAG ACTTAAACAC CAAACCCAAT CCACAGCGGG CAACACAGTT GACCACAGAG
NL/4/01  (B   TCTGCAGTAG ACTTAAACAC CAAACCCAAT CCACAGCAGG CAACACAGTT GACCACAGAG
UK/5/01  (B   TCTGCAGTAG ACTTAAACAC CAAACCCAAT CCACAGCAGG CAACACAGTT GACCACAGAG

....|....| ....|....| ....|....| ....|....| ....|....| ....|....|
                 305        315        325        335        345        355
NL/1/00  (p   GGCTCCACAC TCTACTTTGC AGCCTCAGCA AGCTCACCAG AGACAGAACC AACATCAACA
BR/2/01  (A   GGCTCCACAC TCTACTTTGC AGCCTCAGCA AGCTCACCAG AGACAGAACC AACATCAACA
FL/4/01  (A   GGCTCCACAC TCTACTTTGC AGCCTCAGCA AACTCACCAG AGACAGAACC AACATCAACA
FL/3/01  (A   GGCTCCACAC TCTACTTTGC AGCCTCAGCA AACTCACCAG AGACAGAACC AACATCAACA
FL/8/01  (A   GGCTCCACAC TCTACTTTGC AGCCTCAGCA AGCTCACCAG AGACAGAACC AACATCAACA
FL/10/01 (    GACTCCACAC TCCACTCTGC AGCTTCAGCA AGCTCACCAG AGACAGAACC AACATCAACA
NL/10/01 (    GGCTCCACAC TCCACTTTGC AGCCTCAGCA AGCTCACCAG AGACAGAACC AACATCAACA
NL/2/02  (A   GGCTCCACAC TCCACTTTGC AGCCTCAGCA AGCTCACCAG AGACAGAACC AACATCAACA
NL/17/00 (    AACCCCACAC TCAACCCCGC AGCATCAGCG AGCCCATCAG AAACAGAACC AGCATCAACA
NL/1/81  (A   AGCCCCACAC TCAACCCCGC AGCCTCGGTG AGCCCATCAG AAACAGAACC AGCATCAACA
NL/1/93  (A   AGCCCCACAC TCAACACCGC AGCCTCGGTG AGCCCATCAG AAACAGAACC AGCATCAACA
NL/2/93  (A   AGCCCCACAC TCAACACCGC AGCCTCGGTG AGCCCATCAG AAACAGAACC AGCATCAACA
NL/3/93  (A   AGCCTCACAC TCAACCCCGC AGCCTCGGTG AGCCCATCAG AAACAGAACC AGCATCAACA
NL/1/95  (A   AGCCTCACAC TCAGCCCCAC AGCCTCGGTG AGCCCATCAG AAACAGAACC AGCATCAACA
NL/2/96  (A   AACCCCACAC TAAACCCCGC AGCATCGGTG AGCTCATCAG AAACAGAACC AGCATCAACA
NL/3/96  (A   AGCCTCACAC TCAGCCCCAC AGCCTCGGTG AGCCCATCAG AAACAGAACC AGCATCAACA
NL/22/01 (    AGCCTCACAC TCTACCCCAC ATCCTCGGTG AGCTCATCAG AAACAGAACC AGCATCAACA
NL/24/01 (    AGCCTCACAC TCTACCCCAC ATCCTCGGTG AGCTCATCAG AAACAGAACC AGCATCAACA
NL/23/01 (    AGCCTCACAC TCTACCCCAC ATCCTCGGTG AGCTCATCAG AAACAGAACC AGCATCAACA
NL/29/01 (    AACCCCACAC TCAACCCAGC AGCATCGGCG AGCCCATCAG AAACAGAATC AGCATCAACA
NL/3/02  (A   AACCCCACAC TCAACCCAGC AGCATCAGCG AGCCCATCAG AAACAGAATC AGCATCAACA
NL/1/99  (p   AACTCAACAT CCCCAGTAGC AACCCCAGAG GGCCATCCAT ACACAGGGAC AACTCAAACA
NL/11/00 (    AACTCAACAT CCCCAGCAGC AACCCTAGAG AGCCATCCAT ACACAGGGAC AACCCAAACA
NL/12/00 (    AACTCAACAT TCCCAGCAGC AACCTCAGAG GGCCATCTAC ACACAGGGAC AACTCAAACA
NL/5/01  (B   AACTCAACAT CCCCAGCAGC AACCCCAGAG GGCCATCTAC ACACAGGGAC AACTCAAACA
NL/9/01  (B   AACTCAACAT CCCCAGCAGC AACCCCAGAG GGCCATCTAC ACACAGGGAC AACTCAAACA
NL/21/01 (    AACTCAACAT CCCCAGCAGC AACCCCAGAG GGCCATCTAC ACACAGGGAC AACTCAAACA
NL/1/94  (p   GATTCAACAT CTCTAGCAGC AACCTCAGAG GACCATCTAC ACACAGGGAC AACTCCAACA
NL/1/82  (B   GATTCAACAT CTCTAGCAGC AACCTCAGAG GACCATCTAC ACACAGGGAC AACTCCAACA
NL/1/96  (B   GATTCAACAT CTCTAGCAGC AACCTCGGAG GATCATTTAC TCACAGGGAC AACTCCAACA
NL/6/97  (B   GATTCAACAT CTCTAGCAGC AACCTCAGAG GGCCATCCAC ACACAGGAAC AACTCCAACA
NL/9/00  (B   GATTCTACAT CTTTAGCAGC AACCCTAGAG GACCATCCAC ACACAGGGAC AACTCCAACA
NL/3/01  (B   GATTCAACAT CTCTAGCAGC AACCCTAGAG GGCCATCTAC ACACAGGGAC AACTCCAACA
NL/4/01  (B   GATTCAACAT CTCCAGCAGC AACCCTAGAG GGCCATCTAC ACACAGGGAC AACTCCAACA
UK/5/01  (B   GACTCTACAT CTTTAGCAGC AACCCTAGAG GACCATCCAC ACACAGGGAC AACTCCAACA

....|....| ....|....| ....|....| ....|....| ....|....| ....|....|
                 365        375        385        395        405        415
NL/1/00  (p   CCAGATACAA CAAACCGCCC GCCCTTCGTC GACACACACA CAACACCACC AAGCGCAAGC
BR/2/01  (A   CCAGATACAA CAAACCGCCC GCCCTTCGTC GACACACACA CAACACCACC AAGCGCAAGC
FL/4/01  (A   CCAGACACAA CAAACCGCCC GCCCTTCGTC GACACACACA CAACACCACC AAGCGCAAGC
FL/3/01  (A   CCAGACACAA CAGACCGCCC GCCCTTCGTC GACACACACA CAACACCACC AAGCGCAAGC
FL/8/01  (A   CCAGACACAA CAGACCGCCC GCCCTTCGTC GACACACACA CAACACCACC AAGCGCAAGC
FL/10/01 (    CCAGACACAA CAAGCCGCCC GCCCTTCGTC GACACACACA CAACACCACC AAGTGCAAGC
NL/10/01 (    CCAGACACAA CAAGCCGCCC GCCCTTCGTC GACACACACA CAACACCATC AAGTGCAAGC
NL/2/02  (A   CCAGACACAA CAAGCCGCCC GCCCTTCGTC GACACACACA CAACACCATC AAGTGCAAGC
NL/17/00 (    CCAGACACAA CAAACCGCCT GTCCTCCGTA GACAGGTCCA CAGCACAACC AAGTGAAAGC
NL/1/81  (A   CCAGACACAA CAAACCGCCT GTCCTCCGTA GACAGATCCA CAACACAACC AAGTGAAAGC
```

FIG.19D

```
NL/1/93  (A-   CCAGACACAA CAAACCGCCT GTCCTCCGCA GACAGATCCA CAACACAACC AAGTGAAAGC
NL/2/93  (A    CCAGACACAA CAAACCGCCT GTCCTCCGCA GACAGATCCA CAACACAACC AAGTGAAAGC
NL/3/93  (A    CCAGACACAA CAAACCGCCT GTCCTCCGTA GACAGATCCA CAACACAACC AAGTGAAAGC
NL/1/95  (A    TCAGACACAA CAAGCCGCCT GTCTTCCGTA GACAGATCCA CAACACAACC AAGTGAAAGC
NL/2/96  (A    CCAGACACAA CAAACCGCCT GTCCTCCGTA GACAGGTCCA CAGCACAACC AAGTGAAAGC
NL/3/96  (A    TCAGACACAA CAAACCGCCT GTCTTCCGTA GACAGATCCA CAACACAACC AAGTGAAAGC
NL/22/01 (     CCAGGCATAA CAAACCACCT GTCCTTTGTA GACAGATCCA CAACACAACC AAGTGAAAGC
NL/24/01 (     CCAGGCATAA CAAACCACCT GTCCTTTGTA GACAGATCCA CAACACAACC AAGTGAAAGC
NL/23/01 (     CCAGGCATAA CAAACCACCT GTCCTTTGTA GACAGATCCA CAACACAACC AAGTGAAAGC
NL/29/01 (     CCAGATACAA CAAACCGCCT GTCCTCCGTA GACAGGTCCA CGGTACAACC AAGTGAAAAC
NL/3/02  (A    CCAGATACAA CAAACCGCCT GTCCTCCGTA GACAGGTCCA CGGTACAACC AAGTGAAAAC
NL/1/99  (p    TCAGACACAA CAGCTCCCCA GCAAACCACA GACAAACACA CAGCACCGCT AAAATCAACC
NL/11/00 (     CCAGACACAA CAGCTCCCCA ACAAACCACA GACAAACACA CAGCACTGCC AAAATCAACC
NL/12/00 (     CCAGACACAA CAGCTCCTCA GCAAACCACA GACAAACACA CAGCACTGCC AAAATCAACC
NL/5/01  (B    CCAGACACAA CAGCTCCTCA GCAAACCACA GACAAACACA CAGCACTGCC AAAATCAACC
NL/9/01  (B    CCAGACACAA CAGCTCCTCA GCAAACCACA GACAAGCACA CAGCACTGCC AAAATCAACC
NL/21/01 (     CCAGACACAA CAGCTCCTCA GCAAACCACA GACAAACACA CAGCACTGCC AAAATCAACC
NL/1/94  (p    CCAGATGCAA CAGTCTCTCA GCAAACCACA GACGAGTACA CAACATTGCT GAGATCAACC
NL/1/82  (B    CTAGATGCAA CAGTTTCTCA GCAAACCCCA GACAAGCACA CAACACCGCT GAGATCAACC
NL/1/96  (B    CCAGATGCAA CAGTCTCTCA GCAAACCACA GACGAGCACA CAACACTGCT GAGATCAACC
NL/6/97  (B    CCAGACGCAA CAGTCTCTCA GCAAACCACA GACGAGCACA CAACACTGCT GAGATCAACC
NL/9/00  (B    CCAGATGCAA CAGTCTCTCA GCAAACCACA GACGAGCACA CAACACTGCT GAGATCAACC
NL/3/01  (B    CCAGATGTAA CAGTCTCTCA GCAAACCACA GACGAGCACA CAACACTGCT GAGATCAACC
NL/4/01  (B    CCAGATGCAA CAGTCTCTCA GCAAACCACA GACGAGCACA CAACACTGCT GAGATCAACC
UK/5/01  (B    CCAGATGCAA CAGTCTCTCA GCAAACCACA GACGAGCACA CAACACTGCT GAGATCAACC

....|....| ....|....| ....|....| ....|....| ....|....| ....|....|
                    425        435        445        455        465        475
NL/1/00  (p    AGAACAAAGA CAAGTCCGGC AGTC-CACAC AAAAAA-CAA CCCAAGGACA AGCTCTAG--
BR/2/01  (A    AGAACAAAGA CAAGTCCGGC AGTC-CACAC AAAAAA-CAA CCCAAGGACA AGCTCTAG--
FL/4/01  (A    AGAACAAAGA CAAGTCCGGC AGTC-CACAC AAAAAA-CAA CCCAAGGATA AGCTCCAG--
FL/3/01  (A    AGAACAAAGA CAAGTCCGGC AGTC-CACAC AAAAAA-CAA CCCAAGGATA AGCTCCAG--
FL/8/01  (A    AGAACAAAGA CAAGTCCGGC AGTC-CACAC AAAAAA-CAA CCCAAGGATA AGCTCCAG--
FL/10/01 (     AGGACAAGGA CAAGTCCGGC AGTC-CACAC AAAAAA-CAA TCCAAGGGTA AGCCCCAG--
NL/10/01 (     AGAACAAAGA CAAGTCCGGC AGTC-CACAC AAAAAA-CAA TCTAAGGATA AGCCCCAG--
NL/2/02  (A    AGAATAAGGA CAAGTCCGGC AGTC-CACAC AAAAAA-CAA TCTAAGGATA AGCCCCAG--
NL/17/00 (     AGAACAAAGA CAAAACCGAC AGTC-CACAC AATCAA-CAA CCCAAACACA GCTTCCAG--
NL/1/81  (A    AGAACAAAGA CAAAACCAAC AGTC-CACAC AAAAAA-CAA TCCAAGTACA GTTTCCAG--
NL/1/93  (A    AGAACAAAGA CAAAGCTGAC AGTC-CACAC AAAAAA-CAA CCTAAGTACA GCCTCCAG--
NL/2/93  (A    AGAACAAAGA CAAAGCTGAC AGTC-CACAC AAAAAA-CAA CCTAAGTACA GCCTCCAG--
NL/3/93  (A    AGAACAAAGA CAAAACTGAC AGTC-CACAA AAAAAA-CAT CCCAAGTACA GTCTCTAG--
NL/1/95  (A    AGAGCAAGGA CAAAACCGAC AGTC-CACAA GAAAAA-CAT CCCAAGTACA GTTTCTAG--
NL/2/96  (A.   AGAACAAAGA CAAAACCGAC AGTC-CACAC AAGAAA-CAA CCCAAGCACA GCTTCCAG--
NL/3/96  (A    AGAGCAAGAA CAAAACCGAC AGTC-CACAA GAAAAA-CAT CCCAAGTACA GTTTCTAG--
NL/22/01 (     AGAACAAAGA CAAACCGGAC AGTC-CACAC AAAAAA-CAT CTCAAGTACA GTTTCTAG--
NL/24/01 (     AGAACAAAGA CAAACCGGAC AGTC-CACAA AAAAAA-CAT CTCAAGTACA GTTTCTAG--
NL/23/01 (     AGAACAAAGA CAAACCGGAC AGTC-CACAA AAAAAA-CAT CTCAAGTACA GTTTCTAG--
NL/29/01 (     AGAACAAAGA CAAAACTGAC AGTC-CACAC AAGAAA-CAA CCTAAGCACA GCCTCCAG--
NL/3/02  (A    AGAACAAAGA CAAAACTGAC AGTC-CACAC AAGAAA-CAA CCTAAGCACA GCCTCCAG--
NL/1/99  (p    AATGAACAGA TCACCCAGAC AACCACAGAG AAAAAGACAA TCAGAGCAAC AACCCAAAAA
NL/11/00 (     AATGAACAAA TCACCCAGAC AACCACAGAG AAAAAGACAA CCAGAGCAAC AACCCAAAAA
NL/12/00 (     AATGAACAAA TCACCCAGAC AACCACAGAG AAAAAGACAA CAGAGCAAC  AACCCAAAGA
NL/5/01  (B    AATGAACAGA TCACCCAGGC AACCACAGAG AAAAAGACAA CCAGAGAAAC AACCCAAAGA
NL/9/01  (B    AATGAACAGA TCACCCAGAC AACCACAGAG AAAAAGACAA CCAGAGCAAC AACCCAAAGA
NL/21/01 (     AATGAACAGA TCACCCAGAC AACCACAGAG AAAAAGACAA CCAGAGCAAC AACCCAAAGA
NL/1/94  (p    AACAGACAGA CCCACCCAAAC AACCACAGAG AAAAAGCCAA CCGGAGCAAC AACCAAAA--
NL/1/82  (B    AATGGACAGA CCACCCAGAC AACCACAGAG AAAAAGCCAA CCAGAGCAAT AGCCAAAA--
NL/1/96  (B    AACAGACAGA CCACCCAAAC AACCACAGAG AAAAAGCCAA CCGGAGCAAC AACCAAAA--
NL/6/97  (B    AACAGACAGA CCACCCAAAC AGCCACAGAG AAAAAGCCAA CTGGAGCAAC AACCAAAA--
NL/9/00  (B    AACAGACAGA CCACCCAAAC AACTGCAGAG AAAAAGCCAA CCAGGGCAAC AACCAAAA--
NL/3/01  (B    AACAGACAGA CCACCCAAAC AGCCGCAGAG AAAAAGCCAA CCAGAGTAAC AACTAACA--
```

FIG.19E

```
NL/4/01  (B.  AACAGACAGA CCACCCAAAC AACCGCAGAG AAAAAGCCAA CCAGAGCAAC AACCAAAA--
UK/5/01  (B   AACAGACAGA CCACCCAAAC AACTGCAGAG AAAAAGCCAA CCAGAGCAAC AACCAAAA--

....|....| ....|....| ....|....| ....|....| ....|....| ....|....|
                  485        495        505        515        525        535
NL/1/00  (p   ---------- -AACACATTC TCCACCACGG GCAACGACAA GGACGGC--A CGCAG-AACC
BR/2/01  (A   ---------- -AACACATTC TCCACCACGG GCAACGACAA GGACGGC--A CGCAGGAACC
FL/4/01  (A   ---------- -AACACACTC TCCACCATGG GCAACGACAA GGACGGC--A CGCAG-AACC
FL/3/01  (A   ---------- -AACACATTC TCCACCATGG GCAACGACAA GGACGGC--A CGCAG-AACC
FL/8/01  (A   ---------- -AACACATTC TCCACCATGG GCAACGACAA GGACGGC--A CGCAG-AACC
FL/10/01 (    ---------- -AACACATTC CCCACCATGG GCAATGACAA GGACGGT--C CGCGG-AACC
NL/10/01 (    ---------- -AACACATTC CCCACCATGG GCAATGACAA GGACGGT--C CGTGG-AACC
NL/2/02  (A   ---------- -AACACATTC CCCACCATGG GCAATGACAA GGACGGT--C CGTGG-AACC
NL/17/00 (    ---------- -TACACAATC CCCACCACGG ACAACAACGA AGGCAAT--C CGCAG-AGCC
NL/1/81  (A   ---------- -AACACAATC CCCACTACGG GCAACAACGA AGGCGGT--C CTCAG-AGCC
NL/1/93  (A   ---------- -AACACAATC ACCACCACGG GCAACAACGA AGGCGGT--C CTCAG-AGAC
NL/2/93  (A   ---------- -AACACAATC ACCACCACGG GCAACAACGA AGGCGGT--C CTCAG-AGAC
NL/3/93  (A   ---------- -AACACAATC CTCAATACGG GCAACAACGA AGGCGGT--C CTCAG-AGCC
NL/1/95  (A   ---------- -AACACAATC CCCACTACGG GCAACAACGA AGGCGGT--C CTCAG-AGCC
NL/2/96  (A   ---------- -CACACAATC CCCACCACGG GTAACAACGA AGGCAAT--C CTCAG-AGCC
NL/3/96  (A   ---------- -AACACAATC CCCACTACGG GCAACAACGA AGGCGGT--C CTCAG-AGCC
NL/22/01 (    ---------- -AACACAGTC CCCACCACGG ACAACAGCGA AGGCGGT--C CCCAG-AGCC
NL/24/01 (    ---------- -AACACAGTC CCCACCACGG ACAACAGCGA AGGCGGT--C CCCAG-AGCC
NL/23/01 (    ---------- -AACACAGTC CCCACCACGG ACAACAGCGA AGGCGGT--C CCCAG-AGCC
NL/29/01 (    ---------- -TACACAATC CCCACCACGG GCAACAACGA AGGCAAT--C CGCAG-AGCC
NL/3/02  (A   ---------- -TACACAATC CCCACCACGG GCAACAACGA AGGCAAT--C CGCAG-AGCC
NL/1/99  (p   AGGGAAAAAG GAAAAGAAAA CACAAACCAA ACCACAAGCA CAGCTGCAAC CCAAACAACC
NL/11/00 (    AGGGAAAAAG AAAAAGAAAA CACAAACCAA ACCACAAGCA CAGCTGCAAC CCAAACAACC
NL/12/00 (    AGGGAAAAAG GGAAAGAAAA CACAAACCAA ACCACAAGCA CAGCTGCTAC CCAAACAACC
NL/5/01  (B   AGGGAAAAAG GAAAAGAAAA CACAAACCAA ACCACAAGCA CAGCTGCAAC CCAAACAACC
NL/9/01  (B   AGGGAAAAAG GAAAAGAAAA CACAAACCAA ACCACAAGCA CAGCTGCAAC CCAAACAACC
NL/21/01 (    AGGGAAAAAG GAAAAGAAAA CACAAACCAA ACCACAAGCA CAGCTGCAAC CCAAACAACC
NL/1/94  (p   ---------- ---AAGAAAC CACAACTCGA ACTACAAGCA CAGCTGCAAC CCAAACACTC
NL/1/82  (B   ---------- ---AAGAAAC CACAAACCAA ACCACAAGCA CAGCTGCAAC CCAAACATTC
NL/1/96  (B   ---------- ---AAGAAAC CACAACTCGA ACCACAAGCA CAGCTGCAAC CCAAACACTC
NL/6/97  (B   ---------- ---AAGAAAC CACAACCCGA ACTACAAGTA CAGCTGCAAC CCAAACACCC
NL/9/00  (B   ---------- ---AAGAAAC CACAACTCGA ACCACAAGCA CAGCTGCAAC CCAAACACTC
NL/3/01  (B   ---------- ---AAGAAAC CATAACTCGA ACCACAAGCA CAGCCGCAAC CCAAACACTC
NL/4/01  (B   ---------- ---AAGAAAC CATAACTCGA ACCACAAGCA CAGCTGCAAC CCAAACACTC
UK/5/01  (B   ---------- ---AAGAAAC CACAACTCGA ACCACAAGCA CAGCTGCAAC CCAAACACTC

....|....| ....|....| ....|....| ....|....| ....|....| ....|....|
                  545        555        565        575        585        595
NL/1/00  (p   ACCACTCTCC GCACAAGCAG CACAAGAAAG AGACCGTCCA CAGCATCAGT CCAACCTGAC
BR/2/01  (A   ACCACTCTCC GCACAAGCAG CACAAGAAAG AGACCGTCCA CAGCATCAGT CCAACCTGAC
FL/4/01  (A   ACCACTCTCC GCACAAGCAG CACAAGAAAG AGACCGTCCA CAGCATCAGC CCAACCCGAC
FL/3/01  (A   ACCACTCTCC GCACAAGCAG CACAAGAAAG AGACCGTCCA CAGCATCAGT CCAACCCGAC
FL/8/01  (A   ACCACTCTCC GCACAAGCAG CACAAGAAAG AGACCGTCCA CAGCATCAGT CCAACCCGAC
FL/10/01 (    ACCACTCTCC GCACAAGCAG CACAAGAAAG AGACTGTCTA CAGCATCAGT CCAACCCGAC
NL/10/01 (    ACCACTCTCC GCACAAGCAG CATAAGAAAG AGACCGTCCA CAGCATCAGT CCAACCTGAC
NL/2/02  (A   ACCACTCTCC GCACAAGCAG CATAAGAAAG AGACCGTCCA CAGCATCAGT CCAACCTGAC
NL/17/00 (    ACCACTTTCC GCATGAGCAG CACAGGAAAA AGACCAACCA CAACATTAGT CCAGTCCGAC
NL/1/81  (A   ACCGCTTTCC GCACGAGCAG CACAAGAAAA AGACCAACCA CAACATCAGT CCAGTCTGAC
NL/1/93  (A   ACCGCCTTCC ACACGAGCAG CACAGGAAAA AGACCAACCA CAACATCAGT CCAGTCTGGC
NL/2/93  (A   ACCGCCTTCC ACACGAGCAG CACAGGAAAA AGACCAACCA CAACATCAGT CCAGTCTGGC
NL/3/93  (A   ACCGCCTTTC GCACGAGCAG CACAGGAGAA AGACCAACTA CAACATCAGT CCAGTCTGAC
NL/1/95  (A   ACCGCCTTCC GCACGAGCAG CACAGGAGAG GGACCAACCA CAACATCGGT CCAGTCTGAC
NL/2/96  (A   ACCGTCTTCC GCATGAGCAG CACAGGAAAA AGACCAGCCA CAACATTAGT CCAGTCCGAC
NL/3/96  (A   ACCGCCTTTC GCATGAGCAG CACAGGAGAG GGACCAACCA CAACATCGGT CCAGTCTGAC
NL/22/01 (    ACCGCCCTTC GCACGAGCAG CACAGGAGAA AGACCAACCA CAACACCAGT CCAGCCCGAT
NL/24/01 (    ACCGCCCTTC GCACGAGCAG CACAGGAGAA AGACCAACCA CAACACCAGT CCAGCCCGAT
```

FIG.19F

```
NL/23/01 ( . ACCGCCCTTC GCACGAGCAG CACAGGAGAA AGACCAACCA CAACACCAGT CCAGCCCGAT
NL/29/01 (   ACCACCCTCC GCATGAGCAG CACAGGAAGA AGACCAACCA CAACACTAGT CCAGTCCGAC
NL/3/02  (A  ACCACCCTCC GCATGAGCAG CACAGGAAGA AGACCAACCA CAACACTAGT CCAGTCCGAC
NL/1/99  (p  AACACCACCA ACCAAATCAG AAATGCAAGT GAGACAATCA CAACATCCGA CAGACCCAGA
NL/11/00 (   AACACCACCA ACCAAACCAG AAATGCAAGT GAGACAATCA CAACATCCGA CAGACCCAGA
NL/12/00 (   AACACCACCA ACCAAATCAG AAATGCAAGC GAGACAATCA CAACATCCGA CAGACCCAGA
NL/5/01  (B  AACACCACCA ACCAAATCAG AAATGCAAGC GAGACAATCA CAACATCCGA CAGACCCAGA
NL/9/01  (B  AACACCACCA ACCAAATCAG AAATGCAAGC GAGACAATCA CAACATCCGA CAGACCCAGA
NL/21/01 (   AACACCACCA ACCAAATCAG AAATGCAATT GAGACAATCA CAACATCCGA CAGACCCAGA
NL/1/94  (p  AACACTACCA ACCAAACTAG CTATGTGAGA GAGGCAACCA CAACATCCGC CAGATCCAGA
NL/1/82  (B  AACACCACCA ATCAAACCAG AAATGGAAGA GAGACAACCA TAACATCTGC CAGATCCAGA
NL/1/96  (B  AACACCACCA ACCAAACTAG CAATGGAAGA GAGGCAACCA CAACATCCAC CAGATCCAGA
NL/6/97  (B  AACACCACCA ACCAAACCAG CAATGGAAGA GAGGCAACCA CAACATCCGC CAGGTCCAGA
NL/9/00  (B  AACACCACCA ACCAAACTAG CAATGGAAGA GAGGCAACCA CAACATCTGC CAGATCCAGA
NL/3/01  (B  AACACCACCA ACCAAACCAA CAATGGAAGA GAGGCAACCA CAACATCTGC CAGATCCAGA
NL/4/01  (B  AACACCACCA ACCAAACCAG CAATGGAAGA GAGGCAACCA CAACATCTGC CAGATCCAGA
UK/5/01  (B  AACACCACCA ACCAAACTAG CAATGGAAGA GAGGCAACCA CAACATCTGC CAGATCCAGA

....|....| ....|....| ....|....| ....|....| ....|....| ....|....|
                 605        615        625        635        645        655
NL/1/00  (p  ATCAGCGCAA CAACCCACAA AAACGAAGAA GCAAGTCCAG CGAGCCCACA AACATCTGCA
BR/2/01  (A  ATCAGCGCAA CAACCCACAA AAACGAAGAA GCAAGTCCAG CGAGCCCACA AACATCTGCA
FL/4/01  (A  ATCAGCGCAA CAACCCACAA AAACGAAGAA GCAAGTCCAG CGAGCCCACA AACATCTGCA
FL/3/01  (A  ATCAGCGCAA CAACCCACAA AAACGAAGAA GCAAGTCCAG CGAGCCCACA AACATCTGCA
FL/8/01  (A  ATCAGCGCAA CAACCCACAA AAACGAAGAA GCAAGTCCAG CGAGCCCACA AACATCTGCA
FL/10/01 (   AGCAGCGCAA CAACCCACAA ACACGAAGAA ACAAGCCCAG TGAGCCCACA AACATCTGCA
NL/10/01 (   AGCAGCGCAA CAACCCACAA ACACGAAGAA GCAAGCCCAG TGAGCCCGCA AGCATCTGCA
NL/2/02  (A  AGCAGCGCAA CAACCCACAA ACACGAAGAA GCAAGCCCAG TGAGCCCGCA AGCATCTGCA
NL/17/00 (   AGCAGCACCA CAACCCAAAA TCATGAAGAA ACAGGTTCAG CGAACCCACA GGCGTCTGCA
NL/1/81  (A  AGCAGCACCA CAACCCAAAA TCATGAAGAA ACAAGTTCAG CGAACCCACA GGCATCTGCA
NL/1/93  (A  AGCAGCACCA CAACTCAAAA TCATGAAGAA ACAAGTTCAT CGAACCCACA GGCATCTGCA
NL/2/93  (A  AGCAGCACCA CAACCCAAAA TCATGAAGAA ACAAGTTCAT CGAACCCACA GGCATCTGCA
NL/3/93  (A  AGCAGCACCA CAACCCAAAA TCATGAAGAA ACAGGTTCAG CGAACCCACA GGCATCTGCA
NL/1/95  (A  AGCAGCACCA CAACCCAAAA TCATGAAGAA ACAGGTTCAG CGAACCCACA GGCATCTGCA
NL/2/96  (A  AGCAGCACCA CAACCCAAAA TCATGAAGAA ACAGGTTCAG CAAACTCACA GGCATCTGCA
NL/3/96  (A  AGCAGCACCA CAACCCAAAA TCATGAAGAA ACAGGCTCAG CGAACCCACA GGCATCTGCA
NL/22/01 (   AGCAGCACCA CAACACAAAA TCATGAAGAA ACAGGCTCAG CGAACCCACA GGCATCCGCA
NL/24/01 (   AGCAGCACCA CAACACAAAA TCATGAAGAA ACAGGCTCAG CGAACCCACA GGCATCCGCA
NL/23/01 (   AGCAGCACCA CAACACAAAA TCATGAAGAA ACAGGCTCAG CGAACCCACA GGCATCCGCA
NL/29/01 (   AGCAGCACCA CAACCCAAAA TCATGAAGAA ACAGGCTCAG CGAACCCACA GGCATCTGCA
NL/3/02  (A  AGCAGCACCA CAACCCAAAA TCATGAAGAA ACAGGCTCAG CGAACCCACA GGCATCTGCA
NL/1/99  (p  ACTGACACCA CAACCCAAAA CAGCGAACAG ACAA-CCCGG GCAACAGACC CAAGCTCCCC
NL/11/00 (   ATTGACACCA CAACCCAAAG CAGCGAACAG ACAA-CCCGG GCAACAGACC CAAGCTCCCC
NL/12/00 (   ACTGACTCCA CAACCCAAAG CAGCGAACAG ACAA-CCCGG GCAACAGACC CAAGCTCCCC
NL/5/01  (B  ACTGACTCCA CAACCCAAAG CAGCGAACAG ACAA-CCCGG GCAACAGACC CAAGCTCCCC
NL/9/01  (B  ACTGACTCCA CAACCCAAAG CAGCGAACAG ACAA-CCCGG GCAACAGACC CAAGCTCCCC
NL/21/01 (   ACTGACTCCA CAACCCAAAG CAGCGAACAG ACAA-CCCGG GCAACAGACC CAAGCTCCCA
NL/1/94  (p  AACAGTGCCA CAACTCAAAG CAGCGACCAA ACAA-CCCAG GCAGCAGACC CAAGCTCCCA
NL/1/82  (B  AACGACGCCA CAACTCAAAG CAGCGACACA ACAA-ACCAG ACAACAGACC CAAGCTCCCA
NL/1/96  (B  AACGGTGCCA CAACTCAAAA CAGCGATCAA ACAA-CCTAG ACAGCAGACC CAAGCTCCCA
NL/6/97  (B  AACGGTGCCA CAACTCAAAA CAGCGATCAA ATAA-CCCAG GCAGCAGACT CAAGCTCCCA
NL/9/00  (B  AACAATGCCA CAACTCAAAG CAGCGATCAA ACAA-CCCAG GCAGCAGAAC CAAGCTCCCA
NL/3/01  (B  AACAATGCCA CAACTCAAAG CAGCGACCAA ACAA-CCCAG GCAGCAGACC CAAGCTCCCA
NL/4/01  (B  AACAATGCCA CAACTCAAAG CAGCGACCAA ACAA-CCCAG GCAGCAGACC CAAGCTCCCA
UK/5/01  (B  AACAATGCCA CAACTCAAAG CAGCGATCAA ACAA-CCCAA GCAGCAGAAC CAAACTCCCA

....|....| ....|....| ....|....| ....|....| ....|....| ....|....|
                 665        675        685        695        705        715
NL/1/00  (p  AGCACAACAA GAATACAAAG GAAAAGCGTG GAGGCCAACA CATCAACAAC ATACAACCAA
BR/2/01  (A  AGCACAACAA GAATACAAAG GAAAAGCGTG GAGGCCAACA CATCAACAAC ATACAACCAA
FL/4/01  (A  AGCACAACAA GAACACAAAG GAAAAGCGTG GAGGCCAACA CATCAACAAC ATACAACCAA
```

FIG.19G

```
FL/3/01  (A   AGCACAACAA GAACACAAAG GAAAAGCGTG GAGGCCAACA CATCAACAAC ATACAACCAA
FL/8/01  (A   AGCACAACAA GAACACAAAG GAAAAGCGTG GAGGCCAACA CATCAACAAC ATACAACCAA
FL/10/01 (    AGCACAGCAA GACCACAAAG GAAGGGCATG GAGGCCAGCA CATCAACAAC ATACAACCAA
NL/10/01 (    AGCACAGCAA GACCACAAAG GAAGGGCATG GAGGCCAGCA CATCAACAAC ATACAACCAA
NL/2/02  (A   AGCACAGCAA GACCACAAAG GAAGGGCATG GAGGCCAGCA CATCAACAAC ATACAACCAA
NL/17/00 (    AGCACAATG- -----CAAAA ---------- ----CTAGCA CACCAATAAT ATAAAACCAA
NL/1/81  (A   AGCACAATG- -----CAAAG ---------- ----CCAGCA CACCAACAAC ATAAAACCAA
NL/1/93  (A   AGCACAATG- -----CAAGA ---------- ----CCAGGA CACCAACAAT ACAAAACAAA
NL/2/93  (A   AGCACAATG- -----CAAGA ---------- ----CCAGGA CACCAACAAT ACAAAACAAA
NL/3/93  (A   AGCACAATG- -----CAAAA ---------- ----CTAGCA CACCAACATT GTAAAACCAA
NL/1/95  (A   AGCACAATG- -----CAAAA ---------- ----CTAGCA CACCAACATT GTAAAACCAA
NL/2/96  (A   AGCACAATG- -----CAAAA ---------- ----CTAGCA CTCCAACAAT ATAAAACCAA
NL/3/96  (A   AGCACAATG- -----CAAAA ---------- ----CCAGCA CACCAACATT GCAAAACCAA
NL/22/01 (    AGCACAATG- -----CAAAA ---------- ----CCAGCA CACCAACATT GCAAGACCAA
NL/24/01 (    AGCACAATG- -----CAAAA ---------- ----CCAGCA CACCAACATT GCAAGACCAA
NL/23/01 (    AGCACAATG- -----CAAAA ---------- ----CCAGCA CACCAACATT GCAAGACCAA
NL/29/01 (    AGCACAATG- -----CAAAA ---------- ----CCAGCA CACCAACAAT ATAAAACCAA
NL/3/02  (A   AGCACAATG- -----CAAAA ---------- ----CCAGCA CACCAACAAT ATAAAACCAA
NL/1/99  (p   ACCACACCAT GCATAGAGAG GTGCA----- -AAACTCAAA TGAGCACAAC ACACAAACAT
NL/11/00 (    ACCACACCAT GCACAGAGTG GTGCA----- -AAACCCAAA TGAACACAAC ACACAAACAT
NL/12/00 (    ACCACATCAT GCACAGGGAA GTGCA----- -AAACCCAAA TGAACACAAC ACACAAACAT
NL/5/01  (B   AGCACACCAT GCACAGGGAA GTGCA----- -AAACCCAAA TGAACACAAC ACACAAACAT
NL/9/01  (B   ACCACACCAT GCACAGGGAA GTGCA----- -AAACCCAAA TGAACACAAC ACACAAACAT
NL/21/01 (    CCCACACCAT GCACAGGGAA GTGCA----- -AAACCCAAA TGAACACAAC ACACAAACAT
NL/1/94  (p   ACCACACCAT ACACAGAAAA GCACA----- -ACAACAACA T----ACAAC ACAGACACAT
NL/1/82  (B   ACCACATCAT GCATAGATAA GCACA----- -ATAACAATA TGAACACAAC ACAGACACAT
NL/1/96  (B   ACCACACCAT ACACAGAAAA GCACA----- -ACAACAACA T----ACAAC ACAGACACAT
NL/6/97  (B   ACCACACCAT ACACAGAAAA GCACA----- -ACAACAGCA T----ACAAC ACAGACACAT
NL/9/00  (B   ATCACAACAT ACACAGAAAA GCACA----- -ACAACAACA T----ACAAC ACAGACACAT
NL/3/01  (B   ATCACAACAT ACACAGAAAA GCATA----- -ACAACAACA T----ACAAC ACAGACACAT
NL/4/01  (B   ATCACAACAT ACAAAGAAAA GCACA----- -ACAACAACA T----ACAAC ACAGACACAT
UK/5/01  (B   ATCACAACAT ACACAGAAAA GCACA----- -ACAACAACA T----ACAAC ACAGACACAT

....|....| ....|....| ....|....| ....|....| ....|....| ....|....|
                  725        735        745        755        765        775
NL/1/00  (p   ACTAGTTAAC AAAAAATACA AAATAACTCT AAGATAAACC ATGCAGACAC CAACAATGGA
BR/2/01  (A   ACTAGTTAAC AAAAAATACA AAATAACTCT AAGATAAACC ATGCAGACAC CAACAATGGA
FL/4/01  (A   ACTAGTTAAC AAAAAATACA AAATAACTCT AAGATAAACC ATGCAGACAC CAACAATGGA
FL/3/01  (A   ACTAGTTAAC AAAAAATACA AAATAACTCT AAGATAAACC ATGCAGACAC CAACAATGGA
FL/8/01  (A   ACTAGTTAAC AAAAAATACA AAATAACTCT AAGATAAACC ATGCAGACAC CAACAATGGA
FL/10/01 (    ACTAGTTAAC AAAAAATACA AAATAACTCT AAGATAAACC ATGTAGACAC CAACAATTGA
NL/10/01 (    ACTAGTTAAC AAAAAATATA AAATAACTCT AAGATAAACC ATGTAGACAC CAACAATTGA
NL/2/02  (A   ACTAGTTAAC AAAAAATATA CAATAACTCT AAGATAAACC ATGTAGACAC CAACAATTGA
NL/17/00 (    ATTAGTTAAC AAAAAATGCG AGATAGCTCT AAAGCAAAAC ATGTAGGTAC CAACAATCAA
NL/1/81  (A   ATTAGTTAAC AAAAAATACG AGATAGCTCT AAAGTAAAAC ATGTAGGTAC CAACAATCAA
NL/1/93  (A   ATTAGTTAAC AAAAAATACA AGATAGCTCT AAAGTAAAAC ATGTAGGTAC CAACAGTAAA
NL/2/93  (A   ATTAGTTAAC AAAAAATACA AGATAGCTCT AAAGTAAAAC ATGTAGGTAC CAACAGTAAA
NL/3/93  (A   ATTAGTTAAC AAAAAATATG AAATAGCTCT AAAGTAAAAC ATGTAGGTGC TAACAATCAA
NL/1/95  (A   ATTAGTTAAC AAAAAATATG AAATAGTTCT AAAGTAAAAC ATGTAGGTGC TAACAATCAA
NL/2/96  (A   ATTAGTTAAC AAAAAATACG AGATAGCTCT AAAGTAAAAC ATGTAGGCAC CAACAATCAG
NL/3/96  (A   ATTAGTTAAC AAAAAATATG AAATAGTTCT AAAGTAAAAC ATGTAGGTGC CAACAATCAA
NL/22/01 (    ATTAGTTAAC AAAAAATATG AAATAGCTCT AAAGTAAAAC ATGTAGGTGC CAACAATCAA
NL/24/01 (    ATTAGTTAAC AAAAAATATG AAATAGCTCT AAAGTAAAAC ATGTAGGTGC CAACAATCAA
NL/23/01 (    ATTAGTTAAC AAAAAATATG AAATAGCTCT AAAGTAAAAC ATGTAGGTGC CAACAATCAA
NL/29/01 (    ATTAGTTAAC AAAAAATACG AGATAGCTCT AAAGTAAAAC ATGTAGGCAC CAACAATCAA
NL/3/02  (A   ATTAGTTAAC AAAAAATACG AGATAGCTCT AAAGTAAAAC ATGTAGGCAC CAACAATCAA
NL/1/99  (p   CCCATCCAAG TAGTTA-ACA AAAAA-CCAC AAAATAA-CC TTGAAAAC-C AAAAAA--CC
NL/11/00 (    CTCATCCAAG TAGTTA-ACA AAAAA-CCAC AAAATAA-CC TTGAAAAC-C AAAAAA--CC
NL/12/00 (    CCCATCCAAG TAGTTA-ACA AAAAA----- ---------- ---------- ----------
NL/5/01  (B   CCCATCCAAG TAGTTA-ACA AAAAA-A--- ---------- ---------- ----------
NL/9/01  (B   CCCATCCAAG TAGTTA-ACA AAAAA----- ---------- ---------- ----------
```

FIG.19H

```
NL/21/01  ( .  CCCATCCAAG TAGTTA-ACA AAAAA----- ---------- ---------- ----------
NL/1/94   (p   CCTCTCCAAG TAGTTA-ACA AAAAAACTAT AAAAATAA-TC ATGAAAAC-C GAAAAA-CTA
NL/1/82   (B   CTTCTCCAAG TAGTTA-ACA AAAAA-CTAT AAAAATAA-CC ATGAAAAC-C AAAAAA-CTA
NL/1/96   (B   CTTCTCCAAG TAGTTA-ACA AAAAA-CTAT AAAAATAA-CC ATGAAAAC-T AAAAAA-CTA
NL/6/97   (B   CTTTTCCAAG TAGTTA-ACA AAAAA-CTAT AAAAATAA-CC ATGAAAAC-C AAAAAA-CTA
NL/9/00   (B   CTTCTCTAAG TAGTTA-ACA AAAAAACTAT AAAAATAA-CC ATGAAAAC-C AAAAAA-CTA
NL/3/01   (B   CTTCTCCAAG TAGTTA-ACA AAAAAACTAT AAAATAA-CC ATGAAAAC-C AAAAAAACTA
NL/4/01   (B   CTTCTCCAAG TAGTTA-ACA AAAAAACTAT AAAATAA-CC ATGAAAAC-C AAAAAAACTA
UK/5/01   (B   CTTCTCTAAG TAGTTA-ACA AAAAAACTAT AAAATAA-CC ATGAAAAC-C AAAAAA-CTA

....|....| ....|....| ....|....| ....|....| ....|....| ....|....|
                  785        795        805        815        825        835
NL/1/00   (p   GAAGCCAAAA GACAATTCAC AATCTCCCCA AAAAGGCAAC AACACCATAT TAGC--TCTG
BR/2/01   (A   GAAGCCAAAA GACAATTCAC AATCTCCCCA AAAAGGCAAC AACACCATAT TAGC--TCTG
FL/4/01   (A   GAAGTCAAAA GACAATTCAC AATCTCCCCA AAAAGGCAAC AACACCATAT TAGC--TCTG
FL/3/01   (A   GAAGTCAAAA GACAATTCAC AATCTCCCCA AAAAGGCAAC AACACCATAT TAGC--TCTG
FL/8/01   (A   GAAGTCAAAA GACAATTCAC AATCTCCCCA AAAAGGCAAC AACACCATAT TAGC--TCTG
FL/10/01  (    GAAGCCAAAA GGCAATTCAC AATCTCCC-A AAAAAGCAAC AACACCATAT TAGC--TCCG
NL/10/01  (    GAAGCCAAAA GGCAATTCAC AATCTCCCCA AAAAGGCAAC AACACCATAT TAGC--TCCG
NL/2/02   (A   GAAGCCAAAA GGCAATTCAC AATCTCCCCA AAAAGGCAAC AACACCATAT TAGC--TCCG
NL/17/00  (    GAAACCAAAA GACAACTCAC AATCTCCCTA AAACAGCAAC GACACCATGT CAGC--TTTG
NL/1/81   (A   GGAATCAAAA GACAACTCAC AATCTCCCTA AAACAGCAAC AACATCATGT CAGT--TTTG
NL/1/93   (A   GAAATCAAAA GACAACTCAC AATCTCCCCA AAACAGCAAC AACATCATGT CAGC--TTCG
NL/2/93   (A   GAAATCAAAA GACAACTCAT AATCTCCCCA AAACAGCAAC AACATCATGT CAGC--TTCG
NL/3/93   (A   GAAATCAAAA GACATCTCAT AATCTCTCCA AAACAGCAAC AACATCATGT CAAC--TTTG
NL/1/95   (A   GAAATCAAAA GACAACTCAT AATCTCCCTA AAACAGCAAC AACATCATGT CAAC--TTTG
NL/2/96   (A   GAAATTAAAA GACAACTCAC AACCTCCCTA AAACAGCAAC GACACCATGT CAAC--TTTG
NL/3/96   (A   GAAATCAAAA GACAACTCAC AATCTCCCTA AAACAGCAAC AACATCATGC CAAC--TTTG
NL/22/01  (    GAAATCAAAA GATAACTCAT AATCTCTCTA AAACATCAAC AACATCATGT TAAC--TTTG
NL/24/01  (    GAAATCAAAA GATAACTCAT AATCTCTCTA AAACATCAAC AACATCATGT TAAC--TTTG
NL/23/01  (    GAAATCAAAA GATAACTCAT AATCTCTCTA AAACATCAAC AACATCATGT TAAC--TTTG
NL/29/01  (    GAAACCAAAA GATAACTCAC AATCCCCCCA AAACAGCAAC GACACCATGT CAGC--TTTG
NL/3/02   (A   GAAACCAAAA GATAACTCAC AATCCCCCCA AAACAGCAAC GACACCATGT CAGC--TTTG
NL/1/99   (p   A-----AAAC ATAAACCCAG A---CCCAGA AA--AACATA GACACCATAT GGAAGGTTCT
NL/11/00  (    A-----AACC ACAAACTTAG A---CCCAGA AA--AACATA GACACTATAT GGAAGGTTTG
NL/12/00  (    ---------- ------TCAG A---CCCAGA AA--AACATA GACACTATAT GGAAGGTCCG
NL/5/01   (B   ---------- ------TCAG A---CCCAGA AA--AACACA GACACTATAT GGAAGGTCCG
NL/9/01   (B   ---------- ------TCAG A---CCCAGA AA--AACATA GACACTATAT GGAAGGTCCG
NL/21/01  (    ---------- ------TCAG A---CCCAGA AA--AACATA GACACTATAT GGAAGGTCCG
NL/1/94   (p   G-----AAAA GTTAATTTGA A---CTCAGA AAAGAACACA AACACTATAT GAATTGTTTG
NL/1/82   (B   G-----AAAA GTAAATTTGA A---CTCAGA AAAGAACACA AACACTAAAT GAATTGTTTG
NL/1/96   (B   G-----AAAA GTTAATTTGA A---CTCAGA AAAGAACACA AACACTATAT GAATTGTTTG
NL/6/97   (B   G-----AAAA GTTAATTTGA A---CTCAGA AAAGAACACA AACACTATAT GAATTGTTTG
NL/9/00   (B   G-----AAAA GTTAATTTGA A---CTCAGA AAAGAACACA AACACTATAT GAATTATTTG
NL/3/01   (B   G-----AAAA GTTAATTTGA A---CTCAGA AAAGAACACA AACACTATAT GAATTGTTTG
NL/4/01   (B   G-----AAAA GTTAATTTGA A---CTCAGA AAAGAACACA AACACTATAT GAATTGTTTG
UK/5/01   (B   G-----AAAA GTTAATTTGA A---CTCAGA AAGGAACACA AACACTATAT GAATTATTTG

....|....| ....|....| ....|....| ....|....| ....|....| ....|....|
                  845        855        865        875        885        895
NL/1/00   (p   CCCAAATCTC CCTGGAAAA- AACACTCGCC CATATACCAA AAATACCACA ACCACCCCAA
BR/2/01   (A   CCCAAATCTC CCTGGAAAA- AACACTCGCC CATATACCAA AAATACCACA ACCACCCCAA
FL/4/01   (A   CCCAAATCTC CCTGGAAAA- AACACTCGCC CATATACCAA AAATACCACA ACCACCCCAA
FL/3/01   (A   CCCAAATCTC CCTGGAAAA- AACACTCGCC CATATACCAA AAATACCACA ACCACCCCAA
FL/8/01   (A   CCCAAATCTC CCTGGAAAA- AACACTCGCC CATATACCAA AAATACCACA ACCACCCCAA
FL/10/01  (    CTTAAATCTC CCTGGAAAAA AACACTCGCC CATATACCAA CTATACCACA ACCATCCCAA
NL/10/01  (    CTTAAATCTC CCTGGAAAA- AACACTCGCC CATATACCAA CTATACCACA ACCATCCCAA
NL/2/02   (A   CTTAAGTCTC CCTGGAAAA- AACACTCGCC CATATACCAA CTATACCACA ACCATCCAAA
NL/17/00  (    CTCAAATCTC TCTGGGAGA- AACTTCTACC CACATACTAA CAACATCACA ACCATCTCAA
NL/1/81   (A   CTCAAATCTC CCTGGGAGA- AACTTTCGCC CACATACTAA CAACATCACA ACCATCTCAA
NL/1/93   (A   CTCAAATCTC CCTGGGAGA- AACTCTCGCC CACATACTAA CAACATCACA ACTATCTCAA
```

FIG.19I

```
NL/2/93  (A    CTCAAATCTC CCTGGGAGA- AACTCTCGCC CACATACTAA CAACATCACA ACTATCTCAA
NL/3/93  (A    CTCAAATCTC CCTGGGAGA- AACTTTCGCC CCCATACTGA CAACATCACA ATCATCTCAA
NL/1/95  (A    CTCAAATCTC CCTGGGAGA- AACTTTCGCC CCCATACTGA CAACATCACA ATCATCTCAA
NL/2/96  (A    CTCAAATCTC TCTGGGAGA- AACTTTTGCC CACATACTAA CAACATCACA ATCATCTCAA
NL/3/96  (A    CTCAAATCTC CCTGGGAGA- AACCCTCGCC CCCATACTGA CAACATCACA ATCATCTCAA
NL/22/01 (     CTCAAATCTC TCTGGGAGA- AACCTTCGCC CCCATACTGG CAACATCACA ATCATCTCAA
NL/24/01 (     CTCAAATCTC TCTGGGAGA- AACCTTCGCC CCCATACTGG CAACATCACA ATCATCTCAA
NL/23/01 (     CTCAAATCTC TCTGGGAGA- AACCTTCGCC CCCATACTGG CAACATCACA ATCATCTCAA
NL/29/01 (     CTCAAATCTC TCTGGGAGA- AACTTTTGCC CACATACTAA CAACATCACA ACCATCTCAA
NL/3/02  (A    CTCAAATCTC TCTGGGAGA- AACTTTTGCC CACATACTAA CAACATCACA ACCATCTCAA
NL/1/99  (p    AGCATATGCA CCAATGAGAT GGCATCTGTT CATGTATCAA TAGCACCACC ATCAT-TCAA
NL/11/00 (     AGCATATGCA CCAATGAAAT GGTATCTGTT CATGTATCAA TAGCGCCACC ATTAT-TTAA
NL/12/00 (     AGCATATGCA CCGATGAAAT GGCATTTGTT CATGTATCAA TAGCGCCACC ATTAT-TTAA
NL/5/01  (B    AGCATATGCA CCGATGAAAT GGCATCTGTT CATGTATCAA TAGCACCACC ATTAT-TTAA
NL/9/01  (B    AGCATATGCA CCGATGAAAT GGCATCTGTT CATGTATCAA TAGCGCCACC ATTAT-TTAA
NL/21/01 (     AGCATATGCA CCGATGAAAT GGCATCTGTT CATGTATCAA TAGCGCCACC ATTAT-TTAA
NL/1/94  (p    AGCGTATATA CTAATGAAAT AGCATCTGTT TGTGCATCAA TAATACCATC ATTAT-TTAA
NL/1/82  (B    AGCATATATA CTAATGAAAT AGCATCTGTT CATGCATCAA TAATACCATC ATTAC-TTAA
NL/1/96  (B    AGCGTATATA CTAATGAAAT AGCATCTGTT TGTGCATCAA TAATACCATC ATTAT-TTAA
NL/6/97  (B    AGCGTATATA CTAATGAAAT AGCATCTGTT TGTGCATCAA TAATACCATC ATTAT-TTAA
NL/9/00  (B    AGCGTATATA CTAATGAAAT AGCATCTGTT TGTGCATCAA TAATACCATC ATTAT-TTAA
NL/3/01  (B    AGCGTATATA CTAATGAAAT AGCATCTGTT TGTGCATCAA TAATACCATC ATTAT-TTAA
NL/4/01  (B    AGCGTATATA CTAATGAAAT AGCATCTGTT TGTGCATCAA TAATACCATC ATTAT-TTAA
UK/5/01  (B    AGCGTATATA CTAATGAAAT AGCATCTGTT TGTGCATCAA TAATACCATC ATTAT-TTAA

....|....|  ....|....|  ....|....
                       905        915        925
NL/1/00  (p    GAAAAAAA-C TGGGCAAAAC AACACCCAA
BR/2/01  (A    GAAAAAAA-C TGGGCAAAAC AACACCCAA
FL/4/01  (A    GAAAAAAA-C TGGGCAAAAC AACACCCAA
FL/3/01  (A    GAAAAAAA-C TGGGCAAAAC AACACCCAA
FL/8/01  (A    GAAAAAAA-C TGGGCAAAAC AACACCCAA
FL/10/01 (     GAAAAAGGC TGGGCAAAAC AACACCCAA
NL/10/01 (     GGAAAAAGC TGGGTAAAAC AACACCCAA
NL/2/02  (A    GAAAAAAGC TGGGCAAAAC AACACCCAA
NL/17/00 (     GAAAAGAAAC TGGGCAAAAC AGCATCCAA
NL/1/81  (A    GAAAAGAAAC TGGGCAAAAC AGCACCCAA
NL/1/93  (A    GAAAAGAAAC TGGGCAAAAA AACACTCAA
NL/2/93  (A    GAAAAGAAAC TGGGCAAAAA AACACTCAA
NL/3/93  (A    GAAAAGAAAC TGGGCAAAAC AGCACCAAA
NL/1/95  (A    GAAAAGAAAC TGGGCAAAAC AGCACCAAA
NL/2/96  (A    GAAAAGAAAC TGGGCAAAAC AGCATCCAA
NL/3/96  (A    GAAAAGAAAC TGGGCAAAAC AGCACCAAA
NL/22/01 (     GAAAAGAAAC TGGGCAAAAC AACACCAAA
NL/24/01 (     GAAAAGAAAC TGGGCAAAAC AACACCAAA
NL/23/01 (     GAAAAGAAAC TGGGCAAAAC AACACCCAA
NL/29/01 (     GAAAAGAAAC TGGGCAAAAC AGCATCCAA
NL/3/02  (A    GAAAAGAAAC TGGGCAAAAC AGCATCCAA
NL/1/99  (p    GGAATAAGAA GAGGCAAAA- ---ATTTAA
NL/11/00 (     GGAATAAGAA GAGGCAAAA- ---ATTCAA
NL/12/00 (     GGAATAAGAA GAGGCAAAA- ---ATTCAA
NL/5/01  (B    GGAATAAGAA GAGGCAAAA- ---ATTCAA
NL/9/01  (B    GGAATAAGAA GAGGCAAAA- ---ATTCAA
NL/21/01 (     GGAATAAGAA GAGGCAAGA- ---ATTCAA
NL/1/94  (p    GAAATAAGAA GAAGCTAAA- ---ATTCAA
NL/1/82  (B    GAAATAAGAA GAAGCAAAA- ---ATTCAA
NL/1/96  (B    GAAATAAGAA GAAGCTAAA- ---ATTCAA
NL/6/97  (B    GAAATAAGAA GAAGCTAAA- ---ATTCAA
NL/9/00  (B    GAAATAAGAA GAAGCTAAA- ---ATTCAA
NL/3/01  (B    GAATTAAGAA GAAGCTAAA- ---ATTCAA
NL/4/01  (B    GAATTAAGAA GAAGCTAAA- ---ATTCAA
```

FIG.19J

UK/5/01 (B    GAAATAAGAA GAAGCTAAA- ---ATTCAA

FIG.19K

Alignment: G Protein

```
                       5          15         25         35         45         55
NL/1/00  (p   MEVKVENIRT IDMLKARVKN RVARSKCFKN ASLVLIGITT LSIALNIYLI INYKMQKNTS
BR/2/01  (A   MEVKVENIRT IDMLKASVKN RVARSKCFKN ASLVLIGITT LSIALNIYLI INYKMQKNTS
FL/4/01  (A   MEVKVENIRT IDMLKARVKN RVARSKCFKN ASLVLIGITT LSIALNIYLI INYKMQKNTS
FL/3/01  (A   MEVKVENIRT IDMLKARVKN RVARSKCFKN ASLVLIGITT LSIALNIYLI INYKMQKNTS
FL/8/01  (A   MEVKVENIRT IDMLKARVKN RVARSKCFKN ASLVLIGITT LSIALNIYLI INYKMQKNTS
FL/10/01 (    MEVKVENIRT IDMLKARVKN RVARSKCFKN ASLILIGITT LSIALNIYLI INYTMQENTS
NL/10/01 (    MEVKVENIRT IDMLKARVKN RVARSKCFKN ASLILIGITT LSIALNIYLI INYTMQENTS
NL/2/02  (A   MEVKVENIRT IDMLKARVKN RVARSKCFKN ASLILIGITT LSIALNIYLI INYTMQENTS
NL/17/00 (    MEVKVENIRA IDMLKARVKN RVARSKCFKN ASLILIGITT LSIALNIYLI INYTIQKTTS
NL/1/81  (A   MEVKVENIRA IDMLKARVKN RVARSKCFKN ASLILIGITT LSIALNIYLI INYTIQKTTS
NL/1/93  (A   MEVKVENIRA VDMLKARVKN RVARSKCFKN ASLILVGITT LSIALNIYLI VNYTIQKTTS
NL/2/93  (A   MEVKVENIRA VDMLKARVKN RVARSKCFKN ASLILVGITT LSIALNIYLI VNYTIQKTTS
NL/3/93  (A   MEVKVENIRA IDMLKARMKN RVARSKCFKN ASLILIGITT LSIALNIYLI INYTIQKTTS
NL/1/95  (A   MEVKVENIRA IDMLKARVKN RVARSKCFKN ASLILIGITT LSIALNIYLI INYTIQKTTS
NL/2/96  (A   MEVKVENIRA IDMLKARVKN RVARSKCFKN ASLILIGITT LSIALNIYLI INYTIQKTTS
NL/3/96  (A   MEVKVENIRA IDMLKARVKN RVARSKCFKN ASLILIGITT LSIALNIYLI INYTIQKTTS
NL/22/01 (    MEVKVENIRA IDMLKARVKN RVARSKCFKN ASLILIGITT LSIALNIYLI INYTIQKTTS
NL/24/01 (    MEVKVENIRA IDMLKARVKN RVARSKCFKN ASLILIGITT LSIALNIYLI INYTIQKTTS
NL/23/01 (    MEVKVENIRA IDMLKARVKN RVARSKCFKN ASLILIGITT LSIALNIYLI INYTIQKTTS
NL/29/01 (    MEVKVENIRA IDMLKARVKN RVARSKCFKN ASLILIGITT LSIALNIYLI INYTIQQTTS
NL/3/02  (A   MEVKVENIRA IDMLKARVKN RVARSKCFKN ASLILIGITT LSIALNIYLI INYTIQKTTS
NL/1/99  (p   MEVRVENIRA IDMFKAKIKN RIRSSRCYRN ATLILIGLTA LSMALNIFLI IDHATLRNMI
NL/11/00 (    MEVRVENIRA IDMFKAKIKN RIRSSRCYRN ATLILIGLTA LSMALNIFLI IDHATLRNMI
NL/12/00 (    MEVRVENIRA IDMFKAKIKN RIRSSRCYRN ATLILIGLTA LSMALNIFLI IDHATLRNMI
NL/5/01  (B   MEVRVENIRA IDMFKAKIKN RIRSSRCYRN ATLILIGLTA LSMALNIFLI IDHATLRNMI
NL/9/01  (B   MEVRVENIRA IDMFKAKIKN RIRSSRCYRN ATLILIGLTA LSMALNIFLI IDHATLRNMI
NL/21/01 (    MEVRVENIRA IDMFKAKIKN RIRSSRCYRN ATLILIGLTA LSMALNIFLI IDHATLRNMI
NL/1/94  (p   MEVRVENIRA IDMFKAKMKN RIRSSKCYRN ATLILIGLTA LSMALNIFLI IDYAMLKNMT
NL/1/82  (B   MEVRVENIRT IDMFKAKMKN RIRSSKCYRN ATLILIGLTA LSMALNIFLI IDYATFKNMT
NL/1/96  (B   MEVRVENIRA IDMFKAKMKN RIRSSKCYRN ATLILIGLTA LSMALNIFLI IDYAMLKNMT
NL/6/97  (B   MEVRVENIRA IDMFKAKMKN RIRSSKCYRN ATLILIGLTA LSMALNIFLI IDYATLKNMT
NL/9/00  (B   MEVRVENIRA IDMFKAKMKN RIRSSKCYRN ATLILIGLTA LSMALNIFLI IDYATLKNMT
NL/3/01  (B   MEVRVENIRA IDMFKAKMKN RIRSSKCYRN ATLILIGLSA LSMALNIFLI IDYAKSKNMT
NL/4/01  (B   MEVRVENIRA IDMFKAKMKN RIRSSKCYRN ATLILIGLSA LSMALNIFLI IDYAKSKTMT
UK/5/01  (B   MEVRVENIRA IDMFKAKMKN RIRSSKCYRN ATLILIGLTA LSMALNIFLI IDYATLKNMT 65         75         85         95        105        115
NL/1/00  (p   ESEHHTSSSP MESSRETPTV PTDNSDTNSS PQHPTQQSTE GSTLYFAASA SSPETEPTST
BR/2/01  (A   ESEHHTSSSP MESSRETPTV PTDNSDTNSS PQHPTQQSTE GSTLYFAASA SSPETEPTST
FL/4/01  (A   ESEHHTSSSP MESSRETPTV PTDNSDTNSS PQHPTQQSTE GSTLYFAASA NSPETEPTST
FL/3/01  (A   ESEHHTSSSP MESSRETPTV PTDNSDTNSS PQHPTQQSTE GSTLYFAASA NSPETEPTST
FL/8/01  (A   ESEHHTSSSP MESSRETPTV PTDNSDTNSS PQHPTQQSTE GSTLYFAASA SSPETEPTST
FL/10/01 (    ESEHHTSSSP MESSRETPTV PIDNSDTNPG SQYPTQQSTE DSTLHSAASA SSPETEPTST
NL/10/01 (    ESEHHTSSSP MESSRETPTV PMDNSDTNPG SQYPTQQSTE GSTLHFAASA SSPETEPTST
NL/2/02  (A   ESEHHTSSSP MESSRETPTV PMDNSDTNPG SQYPTQQSTE GSTLHFAASA SSPETEPTST
NL/17/00 (    ESEHHTSSSP TEPNKEASTI STDNPDINPS SQHPTQQSTE NPTLNPAASA SPSETEPAST
NL/1/81  (A   ESEHHTSSPP TESNKETSTI PIDNPDINPN SQHPTQQSTE SPTLNPAASV SPSETEPAST
NL/1/93  (A   ESEHHTSSSP TESNKGTSTI PTDNPDINPN SQHPTQQSTE SPTLNTAASV SPSETEPAST
NL/2/93  (A   ESEHHTSSSP TESNKGTSTI XTDNPDINPN SQHPTQQSTE SPTLNTAASV SPSETEPAST
NL/3/93  (A   ESEHHTSSPP TESNKETSTI PIDNPDINPN SQHPTQQSTE SLTLNPAASV SPSETEPAST
NL/1/95  (A   ESEHHTSSPP TESNKETSTI SIDNPDINPN SQHPTQQSTE SLTLSPTASV SPSETEPAST
NL/2/96  (A   ESEHHTSSPP TESNKEASTI STDNPDINPN SQHPTQQSTE NPTLNPAASV SSSETEPAST
NL/3/96  (A   ESEHHTSSPP TESNKETSTI SIDNSDINPN SQHPTQQSTE SLTLSPTASV SPSETEPAST
NL/22/01 (    ESEHHTSSPP TESNKETSTI PIDNPDINPN SQHPTQQSTE SLTLYPTSSV SSSETEPAST
```

FIG.20A

```
NL/24/01 (    ESEHHTSSPP TESNKETSTI PIDNPDINPN SQHPTQQSAE SLTLYPTSSV SSSETEPAST
NL/23/01 (    ESEHHTSSPP TESNKETSTI PIDNPDINPN SQHPTQQSTE SLTLYPTSSV SSSETEPAST
NL/29/01 (    ESEHHTSSPP TESNKEASTI STDNPDINPN SQHPTQQSTE NPTLNPAASA SPSETESAST
NL/3/02  (A   ESEHHTSSPP TESNKEASTI STDNPDINPN SQHPTQQSTE NPTLNPAASA SPSETESAST
NL/1/99  (p   KTENCANMPS AEPSKKTPMT STAGPNTKPN PQQATQWTTE NSTSPVATPE GHPYTGTTQT
NL/11/00 (    KTENCANMPS AEPSKKTPMT STAGPSTEPN PQQATQWTTE NSTSPAATLE SHPYTGTTQT
NL/12/00 (    KTENCANMPP AEPSKKTPMT STAGPNTKPN PQQATQWTTE NSTFPAATSE GHLHTGTTQT
NL/5/01  (B   KTENCANMPP AEPSRKTPMT STAGPNTKPN PQQATQWTTE NSTSPAATPE GHLHTGTTQT
NL/9/01  (B   KTENCANMPP AEPSKKTPMT STAGLNTKPN PQQATQWTTE NSTSPAATPE GHLHTGTTQT
NL/21/01 (    KTENCANMPP AEPSKKTPMT STAGPNTKPN PQQATQWTTE NSTSPAATPE GHLHTGTTQT
NL/1/94  (p   KVEHCVNMPP VEPSKKTPMT SAVDLNTKPN PQQATQLAAE DSTSLAATSE DHLHTGTTPT
NL/1/82  (B   KVEHCANMPP VEPSKKTPMT STVDSSTGPN PQQTTQWTTE DSTSLAATSE DHLHTGTTPT
NL/1/96  (B   KVEHCVNMPP VEPSKKTPMT SAVDLNTKLN PQQATQLTTE DSTSLAATSE DHLLTGTTPT
NL/6/97  (B   KVEHCVNMPP VEPSKKTPMT SAVDLNTKLN PQQATQLTTE DSTSLAATSE GHPHTGTTPT
NL/9/00  (B   KVEHCVNMPP VEPSKKTPMT SAVDSNTKPN PQQATQLTTE DSTSLAATLE DHPHTGTTPT
NL/3/01  (B   RVEHCVNMPP VEPSKKTPMT SAVDLNTKPN PQRATQLTTE DSTSLAATLE GHLHTGTTPT
NL/4/01  (B   RVEHCVNMPP VEPSKKTPMT SAVDLNTKPN PQQATQLTTE DSTSPAATLE GHLHTGTTPT
UK/5/01  (B   KVEHCVNMPP VEPSKKTPMT SAVDLNTKPN PQQATQLTTE DSTSLAATLE DHPHTGTTPT

....|....| ....|....| ....|....| ....|....| ....|....| ....|....|
                      125        135        145        155        165        175
NL/1/00  (p   PDTTNRPPFV DTHTTPPSAS RTKTSPAVHT KNNPRTSSR- -----THSPP RATTRTARRT
BR/2/01  (A   PDTTNRPPFV DTHTTPPSAS RTKTSPAVHT KNNPRTSSR- -----THSPP RATTRTARRT
FL/4/01  (A   PDTTNRPPFV DTHTTPPSAS RTKTSPAVHT KNNPRISSR- -----THSPP WATTRTARRT
FL/3/01  (A   PDTTDRPPFV DTHTTPPSAS RTKTSPAVHT KNNPRISSR- -----THSPP WATTRTARRT
FL/8/01  (A   PDTTDRPPFV DTHTTPPSAS RTKTSPAVHT KNNPRISSR- -----THSPP WATTRTARRT
FL/10/01 (    PDTTSRPPFV DTHTTPPSAS RTRTSPAVHT KNNPRVSPR- -----THSPP WAMTRTVRGT
NL/10/01 (    PDTTSRPPFV DTHTTPSSAS RTKTSPAVHT KNNLRISPR- -----THSPP WAMTRTVRGT
NL/2/02  (A   PDTTSRPPFV DTHTTPSSAS RIRTSPAVHT KNNLRISPR- -----THSPP WAMTRTVRGT
NL/17/00 (    PDTTNRLSSV DRSTAQPSES RTKTKPTVHT INNPNTASS- -----TQSPP RTTTKAIRRA
NL/1/81  (A   PDTTNRLSSV DRSTTQPSES RTKTKPTVHT KNNPSTVSR- -----TQSPL RATTKAVLRA
NL/1/93  (A   PDTTNRLSSA DRSTTQPSES RTKTKLTVHT KNNLSTASR- -----TQSPP RATTKAVLRD
NL/2/93  (A   PDTTNRLSSA DRSTTQPSES RTKTKLTVHT KNNLSTASR- -----TQSPP RATTKAVLRD
NL/3/93  (A   PDTTNRLSSV DRSTTQPSES RTKTKLTVHK KNIPSTVSR- -----TQSSI RATTKAVLRA
NL/1/95  (A   SDTTSRLSSV DRSTTQPSES RARTKPTVHK KNIPSTVSR- -----TQSPL RATTKAVLRA
NL/2/96  (A   PDTTNRLSSV DRSTAQPSES RTKTKPTVHT RNNPSTASS- -----TQSPP RVTTKAILRA
NL/3/96  (A   SDTTNRLSSV DRSTTQPSES RARTKPTVHK KNIPSTVSR- -----TQSPL RATTKAVLRA
NL/22/01 (    PGITNHLSFV DRSTTQPSES RTKTNRTVHK KNISSTVSR- -----TQSPP RTTAKAVPRA
NL/24/01 (    PGITNHLSFV DRSTTQPSES RTKTNRTVHK KNISSTVSR- -----TQSPP RTTAKAVPRA
NL/23/01 (    PGITNHLSFV DRSTTQPSES RTKTNRTVHK KNISSTVSR- -----TQSPP RTTAKAVPRA
NL/29/01 (    PDTTNRLSSV DRSTVQPSEN RTKTKLTVHT RNNLSTASS- -----TQSPP RATTKAIRRA
NL/3/02  (A   PDTTNRLSSV DRSTVQPSEN RTKTKLTVHT RNNLSTASS- -----TQSPP RATTKAIRRA
NL/1/99  (p   SDTTAPQQTT DKHTAPLKST NEQITQTTTE KKTIRATTQK REKGKENTNQ TTSTAATQTT
NL/11/00 (    PDITAPQQTT DKHTALPKST NEQITQTTTE KKTTRATTQK REKEKENTNQ TTSTAATQTT
NL/12/00 (    PDTTAPQQTT DKHTALPKST NEQITQTTTQ KKTTRATTQR REKGKENTNQ TTSTAATQTT
NL/5/01  (B   PDTTAPQQTT DKHTALPKST NEQITQATTE KKTTRETTQR REKGKENTNQ TTSTAATQTT
NL/9/01  (B   PDTTAPQQTT DKHTALPKST NEQITQTTTE KKTTRATTQR REKGKENTNQ TTSTAATQTT
NL/21/01 (    PDTTAPQQTT DKHTALPKST NEQITQTTTE KKTTRATTQR REKGKENTNQ TTSTAATQTT
NL/1/94  (p   PDATVSQQTT DEYTTLLRST NRQTTQTTTE KKPTGATTK- ----KETTTR TTSTAATQTL
NL/1/82  (B   LDATVSQQTP DKHTTPLRST NGQTTQTTTE KKPTRAIAK- ----KETTNQ TTSTAATQTF
NL/1/96  (B   PDATVSQQTT DEHTTLLRST NRQTTQTTTE KKPTGATTK- ----KETTTR TTSTAATQTL
NL/6/97  (B   PDATVSQQTT DEHTTLLRST NRQTTQTATE KKPTGATTK- ----KETTTR TTSTAATQTP
NL/9/00  (B   PDATVSQQTT DEHTTLLRST NRQTTQTTAE KKPTRATTK- ----KETTTR TTSTAATQTL
NL/3/01  (B   PDVTVSQQTT DEHTTLLRST NRQTTQTAAE KKPTRVTTN- ----KETITR TTSTAATQTL
NL/4/01  (B   PDATVSQQTT DEHTTLLRST NRQTTQTTAE KKPTRATTK- ----KETITR TTSTAATQTL
UK/5/01  (B   PDATVSQQTT DEHTTLLRST NRQTTQTTAE KKPTRATTK- ----KETTTR TTSTAATQTL

....|....| ....|....| ....|....| ....|....| ....|....| ....|....|
                      185        195        205        215        225        235
NL/1/00  (p   TTLRTSSTRK RPSTASVQPD ISATTHKNEE ASPASPQTSA STTRIQRKSV EANTSTTYNQ
BR/2/01  (A   TTLRTSSTRK RPSTASVQPD ISATTHKNEE ASPASPQTSA STTRIQRKSV EANTSTTYNQ
```

FIG.20B

```
FL/4/01  (A   TTLRTSSTRK  RPSTASAQPD  ISATTHKNEE  ASPASPQTSA  STTRTQRKSV  EANTSTTYNQ
FL/3/01  (A   TTLRTSSTRK  RPSTASVQPD  ISATTHKNEE  ASPASPQTSA  STTRTQRKSV  EANTSTTYNQ
FL/8/01  (A   TTLRTSSTRK  RPSTASVQPD  ISATTHKNEE  ASPASPQTSA  STTRTQRKSV  EANTSTTYNQ
FL/10/01 (    TTLRTSSTRK  RLSTASVQPD  SSATTHKHEE  TSPVSPQTSA  STARPQRKGM  EASTSTTYNQ
NL/10/01 (    TTLRTSSIRK  RPSTASVQPD  SSATTHKHEE  ASPVSPQASA  STARPQRKGM  EASTSTTYNQ
NL/2/02  (A   TTLRTSSIRK  RPSTASVQPD  SSATTHKHEE  ASPVSPQASA  STARPQRKGM  EASTSTTYNQ
NL/17/00 (    TTFRMSSTGK  RPTTTLVQSD  SSTTTQNHEE  TGSANPQASA  STMQN-----  ----HTNNIK
NL/1/81  (A   TAFRTSSTRK  RPTTTSVQSD  SSTTTQNHEE  TSSANPQASA  STMQSQ----  ----HTNNIK
NL/1/93  (A   TAFHTSSTGK  RPTTTSVQSG  SSTTTQNHEE  TSSSNPQASA  STMQDQ----  ----DTNNTK
NL/2/93  (A   TAFHTSSTGK  RPTTTSVQSG  SSTTTQNHEE  TSSSNPQASA  STMQDQ----  ----DTNNTK
NL/3/93  (A   TAFRTSSTGE  RPTTTSVQSD  SSTTTQNHEE  TGSANPQASA  STMQN-----  ----HTNIVK
NL/1/95  (A   TAFRTSSTGE  GPTTTSVQSD  SSTTTQNHEE  TGSANPQASA  STMQN-----  ----HTNIVK
NL/2/96  (A   TVFRMSSTGK  RPATTLVQSD  SSTTTQNHEE  TGSANSQASA  STMQN-----  ----HSNNIK
NL/3/96  (A   TAFRMSSTGE  GPTTTSVQSD  SSTTTQNHEE  TGSANPQASA  STMQNQ----  ----HTNIAK
NL/22/01 (    TALRTSSTGE  RPTTTPVQPD  SSTTTQNHEE  TGSANPQASA  STMQNQ----  ----HTNIAR
NL/24/01 (    TALRTSSTGE  RPTTTPVQPD  SSTTTQNHEE  TGSANPQASA  STMQNQ----  ----HTNIAR
NL/23/01 (    TALRTSSTGE  RPTTTPVQPD  SSTTTQNHEE  TGSANPQASA  STMQNQ----  ----HTNIAR
NL/29/01 (    TTLRMSSTGR  RPTTTLVQSD  SSTTTQNHEE  TGSANPQASA  STMQNQ----  ----HTNNIK
NL/3/02  (A   TTLRMSSTGR  RPTTTLVQSD  SSTTTQNHEE  TGSANPQASA  STMQNQ----  ----HTNNIK
NL/1/99  (p   NTTNQIRNAS  ETITTSDRPR  TDTTTQSSEQ  TTRATDPSSP  PHHAR-----  ----GAKLK-
NL/11/00 (    NTTNQTRNAS  ETITTSDRPR  IDTTTQSSDQ  TTRATDPSSP  PHHAQS----  ----GAKPK-
NL/12/00 (    NTTNQIRNAS  ETITTSDRPR  TDSTTQSSEQ  TTRATDPSSP  PHHAQG----  ----SAKPK-
NL/5/01  (B   NTTNQIRNAS  ETITTSDRPR  TDSTTQSSEQ  TTQATDPSSP  AHHAQG----  ----SAKPK-
NL/9/01  (B   NTTNQIRNAS  ETITTSDRPR  TDSTTQSSEQ  TTRATDPSSP  PHHAQG----  ----SAKPK-
NL/21/01 (    NTTNQIRNAI  ETITTSDRPR  TDSTTQSSEQ  TTRATDPSSH  PHHAQG----  ----SAKPK-
NL/1/94  (p   NTTNQTSYVR  EATTTSARSR  NSATTQSSDQ  TTQAADPSSQ  PHHTQK----  ----STTTTY
NL/1/82  (B   NTTNQTRNGR  ETTITSARSR  NDATTQSSEQ  TNQTTDPSSQ  PHHAIS----  ----TITITQ
NL/1/96  (B   NTTNQTSNGR  EATTTSTRSR  NGATTQNSDQ  TT-TADPSSQ  PHHTQK----  ----STTTTY
NL/6/97  (B   NTTNQTSNGR  EATTTSARSR  NGATTQNSDQ  ITQAADSSSQ  PHHTQK----  ----STTTAY
NL/9/00  (B   NTTNQTSNGR  EATTTSARSR  NNATTQSSDQ  TTQAAEPSSQ  SQHTQK----  ----STTTTY
NL/3/01  (B   NTTNQTNNGR  EATTTSARSR  NNATTQSSDQ  TTQAADPSSQ  SQHTQK----  ----SITTTY
NL/4/01  (B   NTTNQTSNGR  EATTTSARSR  NNATTQSSDQ  TTQAADPSSQ  SQHTKK----  ----STTTTY
UK/5/01  (B   NTTNQTSNGR  EATTTSARSR  NNATTQSSDQ  TTQAAEPNSQ  SQHTQK----  ----STTTTY

....|....
                 245
NL/1/00  (p   TS-------
BR/2/01  (A   TS-------
FL/4/01  (A   TS-------
FL/3/01  (A   TS-------
FL/8/01  (A   TS-------
FL/10/01 (    TS-------
NL/10/01 (    TS-------
NL/2/02  (A   TS-------
NL/17/00 (    PN-------
NL/1/81  (A   PN-------
NL/1/93  (A   QN-------
NL/2/93  (A   QN-------
NL/3/93  (A   PN-------
NL/1/95  (A   PN-------
NL/2/96  (A   PN-------
NL/3/96  (A   PN-------
NL/22/01 (    PN-------
NL/24/01 (    PN-------
NL/23/01 (    PN-------
NL/29/01 (    PN-------
NL/3/02  (A   PN-------
NL/1/99  (p   ---------
NL/11/00 (    ---------
NL/12/00 (    ---------
NL/5/01  (B   ---------
```

FIG.20C

```
NL/9/01  (B.  ----------
NL/21/01 (    ----------
NL/1/94  (p   NTDTSSPSS
NL/1/82  (B   HRHIFSK--
NL/1/96  (B   NTDTSSPSS
NL/6/97  (B   NTDTSFPSS
NL/9/00  (B   NTDTSSLSS
NL/3/01  (B   NTDTSSPSS
NL/4/01  (B   NTDTSSPSS
UK/5/01  (B   NTDTSSLSS
```

FIG.20D

Phylogenetic analysis of G sequences

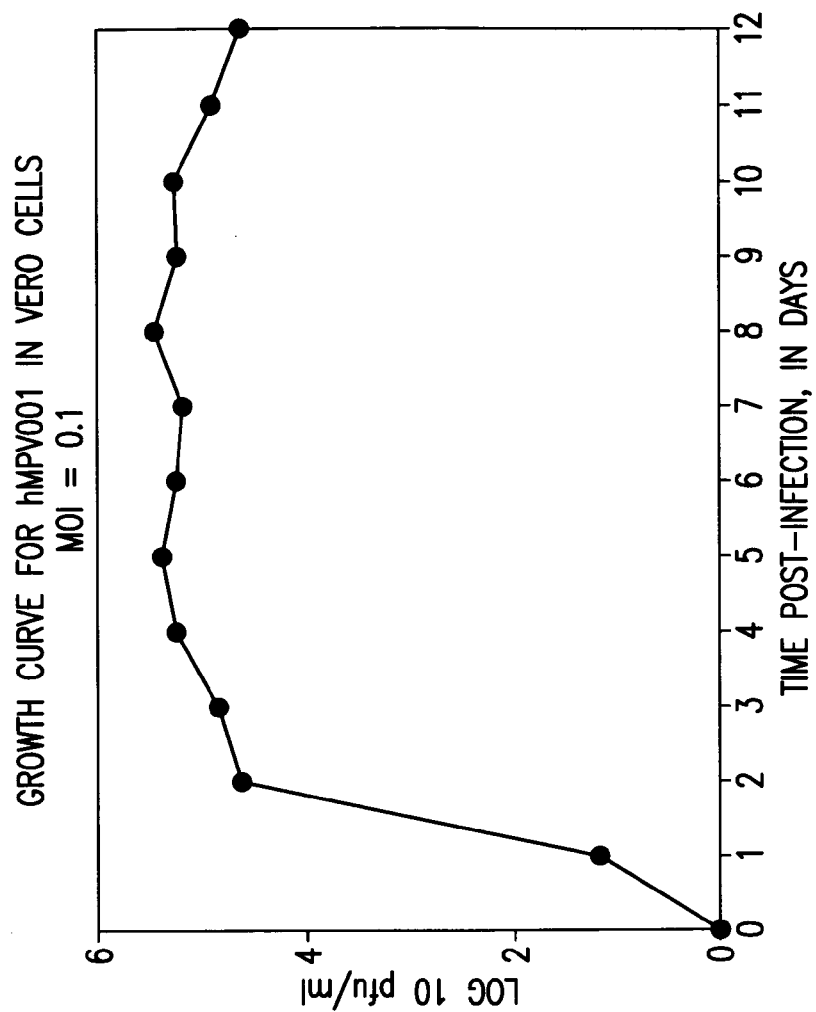

```
                                            AccI
CATATTGTAATACGACTCACTATAGGACGGCAAAAAAACCGTATACATCCAATTATAATTTCTTATTTTTAATAAA
|---|---|---|---|---|---|---|---|---|---|---|---|---|---|---|---|---|---|---+ 76
GTATAACATTATGCTGAGTGATATCCTGCCGTTTTTTTGGCATATGTAGGTTAATATTAAAGAATAAAAATTATTT

——— P-T7 ———▶|                  ——— Tr ———

PacI
CTTAATGACAGTTGTTAGTTTCTAACTTTTGATTTTTAGTTTTTAATTAACTATTACATAATTGCATAATCAAATG
|---|---|---|---|---|---|---|---|---|---|---|---|---|---|---|---|---|---|---+ 152
GAATTACTGTCAACAATCAAAGATTGAAAACTAAAAATCAAAAATTAATTGATAATGTATTAACGTATTAGTTTAC

——— Tr ———

ATTACTTTGGAATAGTATGAAGTTGTCACCTATTTTATCATTTTTATCATTTTTTACGCCCCGCCCTGCCACTCAT
|---|---|---|---|---|---|---|---|---|---|---|---|---|---|---|---|---|---|---+ 228
TAATGAAACCTTATCATACTTCAACAGTGGATAAAATAGTAAAAATAGTAAAAAATGCGGGGCGGGACGGTGAGTA

——— Tr ———                        | A  G  G  Q  W  E  D
                                                ——— CAT ———
```

Scal

```
CGCAGTACTGTTGTAATTCATTAAGCATTCTGCCCGACATGGAAGCCATCACAAACGGCATGATGAACCTGAATCGC
+---|---|---|---|---|---|---|---|---|---|---|---|---|---|---|---|---|---|---+ 304
GCGTCATGACAACATTAAGTAATTCGTAAGACGGGCTGTACCTTCGGTAGTGTTTGCCGTACTACTTGGACTTAGCG

C  Y  Q  Q  L  E  N  L  M  R  G  V  H  F  G  D  C  V  A  H  H  V  Q  I  A
                                  ——— CAT ———
```

SspI   NcoI

```
CAGCGGCATCAGCACCTTGTCGCCTTGCGTATAATATTTGCCCATGGTGAAAACGGGGGCGAAGAAGTTGTCCATA
+---|---|---|---|---|---|---|---|---|---|---|---|---|---|---|---|---|---|---+ 380
GTCGCCGTAGTCGTGGAACAGCGGAACGCATATTATAAACGGGTACCACTTTTGCCCCCGCTTCTTCAACAGGTAT

L  P  M  L  V  K  D  G  Q  T  Y  Y  K  G  M  T  F  V  P  A  F  F  N  D  M
                                  ——— CAT ———
```

FIG. 24A

```
        MscI    DraI                                                    BsmBI
TTGGCCACGTTTAAATCAAAACTGGTGAAACTCACCCAGGGATTGGCTGAGACGAAAAACATATTCTCAATAAACC
++++|++++|++++|++++|++++|++++|++++|++++|++++|++++|++++|++++|++++|++++|++++456
AACCGGTGCAAATTTAGTTTTGACCACTTTGAGTGGGTCCCTAACCGACTCTGCTTTTTGTATAAGAGTTATTTGG

N  A  V  N  L  D  F  S  T  F  S  V  W  P  N  A  S  V  F  F  M  N  E  I  F  G
 ─────────────────────────────────── CAT ───────────────────────────────────

CTTTAGGGAAATAGGCCAGGTTTTCACCGTAACACGCCACATCTTGCGAATATATGTGTAGAAACTGCCGGAAATC
++++|++++|++++|++++|++++|++++|++++|++++|++++|++++|++++|++++|++++|++++|++++532
GAAATCCCTTTATCCGGTCCAAAAGTGGCATTGTGCGGTGTAGAACGCTTATATACACATCTTTGACGGCCTTTAG

K  P  F  Y  A  L  N  E  G  Y  C  A  V  D  Q  S  Y  I  H  L  F  Q  R  F  D
 ──────────────────────────────── CAT ────────────────────────────────

GTCGTGGTATTCACTCCAGAGCGATGAAAACGTTTCAGTTTGCTCATGGAAAACGGTGTAACAAGGGTGAACACTA
++++|++++|++++|++++|++++|++++|++++|++++|++++|++++|++++|++++|++++|++++|++++608
CAGCACCATAAGTGAGGTCTCGCTACTTTTGCAAAGTCAAACGAGTACCTTTTGCCACATTGTTCCCACTTGTGAT

D  H  Y  E  S  W  L  S  S  F  T  E  T  Q  E  H  F  V  T  Y  C  P  H  V  S
 ──────────────────────────────── CAT ────────────────────────────────

EcoRI
TCCCATATCACCAGCTCACCGTCTTTCATTGCCATACGGAATTCCGGATGAGCATTCATCAGGCGGGCAAGAATGT
++++|++++|++++|++++|++++|++++|++++|++++|++++|++++|++++|++++|++++|++++|++++684
AGGGTATAGTGGTCGAGTGGCAGAAAGTAACGGTATGCCTTAAGGCCTACTCGTAAGTAGTCCGCCCGTTCTTACA

D  W  I  V  L  E  G  D  K  M  A  M  R  F  E  P  H  A  N  M  L  R  A  L  I  H
 ──────────────────────────────── CAT ────────────────────────────────

DraI         PvuII
GAATAAAGGCCGGATAAAACTTGTGCTTATTTTTCTTTACGGTCTTTAAAAAGGCCGTAATATCCAGCTGAACGGT
++++|++++|++++|++++|++++|++++|++++|++++|++++|++++|++++|++++|++++|++++|++++760
CTTATTTCCGGCCTATTTTGAACACGAATAAAAAGAAATGCCAGAAATTTTTCCGGCATTATAGGTCGACTTGCCA

I  F  A  P  Y  F  K  H  K  N  K  K  V  T  K  L  F  A  T  I  D  L  Q  V  T
 ──────────────────────────────── CAT ────────────────────────────────
```

FIG.24B

```
CTGGTTATAGGTACATTGAGCAAGTGACTGAAATGCCTCAAAATGTTCTTTACGATGCGATTGGGATATATCAACG
                                                                         836
GACCAATATCCATGTAACTCGTTCACTGACTTTACGGAGTTTTACAAGAAATGCTACGCTAACCCTATATAGTTGC

Q  N  Y  T  C  Q  A  L  S  Q  F  A  E  F  H  E  K  R  H  S  Q  S  I  D  V
  ─────────────────────────────── CAT ───────────────────────────────────────
```

```
                                                                    AfIIII
         AccI                                                        MluI

GNGGTATACCCAGTGATTTTTTTCTCCATTTTCACTTGTCCCATATTTTTTTGGAATCTAATTTATACGCGTTTTT
                                                                         912
CNCCATATGGGTCACTAAAAAAAGAGGTAAAAGTGAACAGGGTATAAAAAAACCTTAGATTAAATATGCGCAAAAA

?  T  Y  G  T  I  K  K  E  M ─────────────── Le+AC ──────────────
  ─────────── CAT ───────────
```

```
                          KasI
         NgoMIV            NgoMIV

TTCGCGTGGCCGGCATGGTCCCAGCCTCCTCGCTGGCGCCGGCTGGGCAACATTCCGAGGGGACCGTCCCCTCGGT
                                                                         988
AAGCGCACCGGCCGTACCAGGGTCGGAGGAGCGACCGCGGCCGACCCGTTGTAAGGCTCCCCTGGCAGGGGAGCCA

─Le+AC─│─────────────────── Hep-d Ribo ───────────────────
```

```
         BamHI

AATGGCGAATGGGACGGATCCGGCTGCTAACAAAGCCCGAAA
                                         1030
TTACCGCTTACCCTGCCTAGGCCGACGATTGTTTCGGGCTTT

─Hep-d Ribo─│       ├──── T-T7 ────┤
FIG.24
```

FIG. 24C

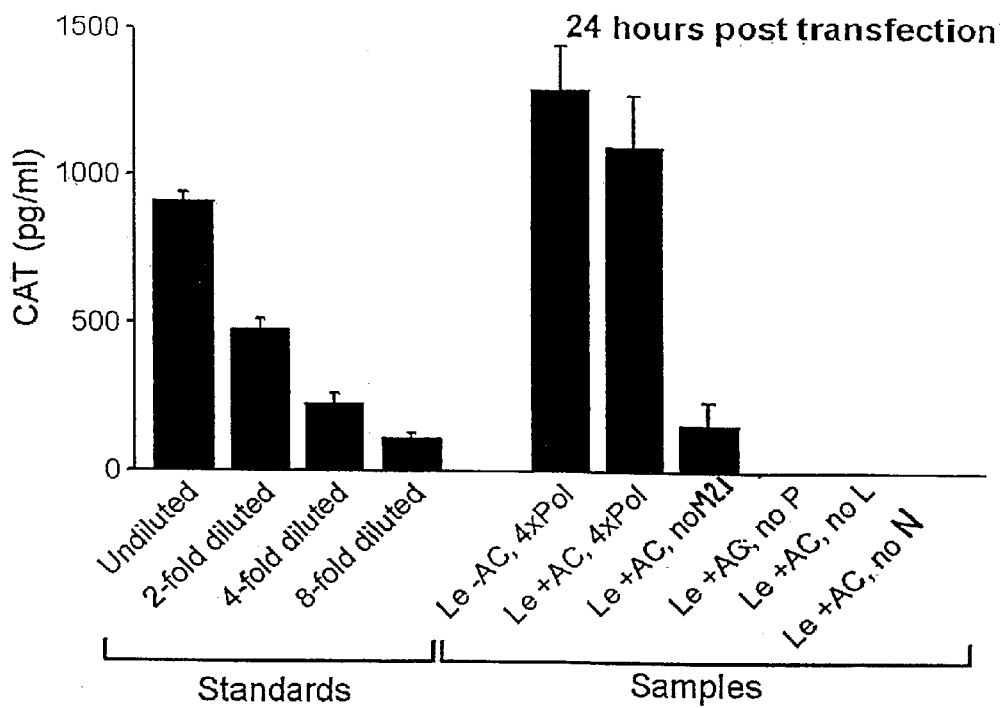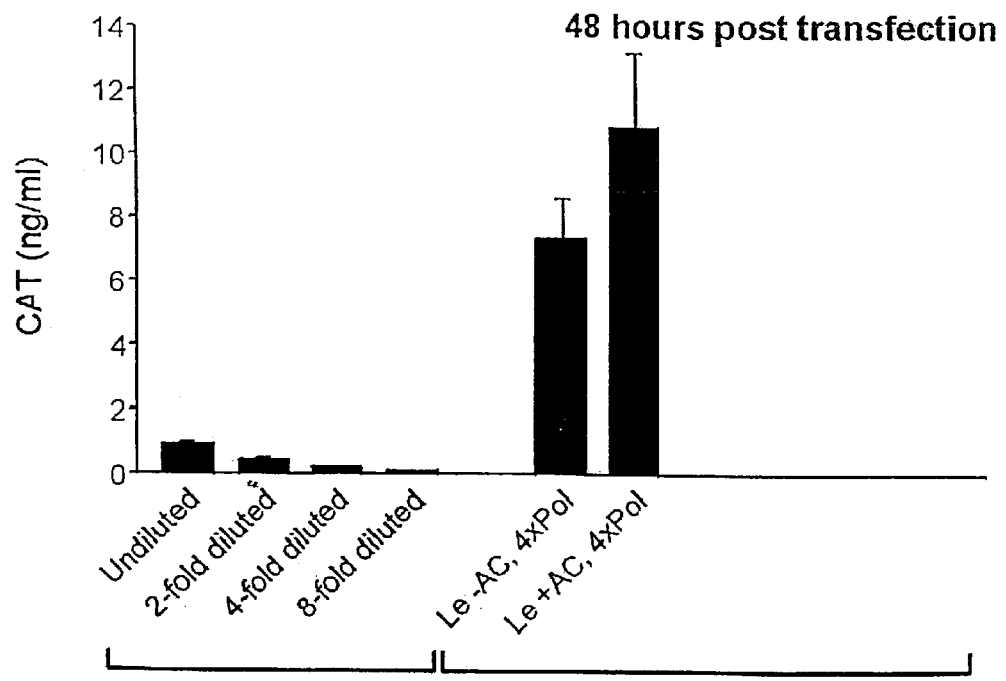
FIGURE 25

Leader and Trailer Sequence Comparison

```
hMPV le   ACG CGA AAA AAA C  GC GTA TA
hMPV tr   TGC CCT TTT TTT G  GC ATA T

AVP le    ACG AGA AAA AAA C  GC ATT CAA GCA GG
APV tr    TGC TCT TTT TTT G  GC ATA AGT AGT TT

RSV A2 le ACG GGA AAA AAT GCG TAC AAC AAA CTT
RSV A2 tr TGC TCT TTT TTT CAC AGT TTT T

BRSV le   ACG CGA AAA AAT GCG TAT AAC AAA CCT GT
BRSV tr   TGC TCT TTT TTT CAT AGT TTT TG

HPIV3 le  ACC AAA CAA GAG AAG A  GA CTT
HPIV3 tr  TGG TTT GTT CTC TTC T  TG AGA

BPIV3 le  ACC AAA CAA GAG AAG A  GA CTT
BPIV3 tr  TGG TTT GTT CTC TTT T  TG AGA
```

Yellow color are non-complementary nucleotides between leader and trailer sequences Green color is a nucleotide to be tested next: change C → A or G

+ = positive; - = negative; T = throatswabs; NO = nose swab; N = not done; ? = not sure;
D = dead; 0 to 12: days post infection. 2e infection is only tested on nose swabs.

| nr | 1ᵉ infection | swab | 0 | 1 | 2 | 3 | 4 | 5 | 8 | 10 | 11 | 12 | 2ᵉ infection | 0 | 1 | 2 | 3 | 4 | 5 |
|----|----|----|----|----|----|----|----|----|----|----|----|----|----|----|----|----|----|----|----|
| 1 | 00-1 | T | - | + | + | + | - | + | + | + | - | - | 99-1 | N | N | N | N | N | N |
|  |  | NO | - | + | + | + | + | + | N | + | - | - |  | - | - | - | - | - | - |
| 2 | 00-1 | T | - | + | + | + | + | + | - | - | - | D |  | N | N | N | N | N | N |
|  |  | NO |  | + | + | + | + | + | N | + | - | D |  | - | - | - | - | - | - |
| 3 | 00-1 | T | - | - | ? | - | - | - | - | - | - | N | 99-1 | N | N | ? | N | N | N |
|  |  | NO |  | + | ? | ? |  | - | N | - | - | - |  | - | - | ? | + | + | - |
| 4 | 00-1 | T | - | + | + | + | + | + | - | ? | - | N | 00-1 | N | N | N | N | N | N |
|  |  | NO | - | + | + | + | + | + | N | ? | - | - |  | - | - | - | + | - | - |
| 5 | 00-1 | T | - | ? | + | + | + | + | + | + | - | N | 00-1 | N | N | N | N | N | N |
|  |  | NO |  | + | + | + | + | + | N | + | - | - |  | - | - | - | - | - | - |
| 6 | 00-1 | T | - | - | + | + | + | + | - | + | - | N | 00-1 | N | N | N | N | N | N |
|  |  | NO | - | + | + | + | + | + | N | + | + | ? |  | - | - | - | - | - | - |
| 7 | 99-1 | T | - | - | - | + | + | - | + | D | - | - |  | N | N | N | N | N | N |
|  |  | NO | - | - | — | + | + | + | N | D | - | - |  | - | - | - | - | - | - |
| 8 | 99-1 | T | - | - | + | + | - | - | - | - | - | N | 00-1 | N | N | N | N | N | N |
|  |  | NO | - | ? | - | + | + | ? | N | - | - | -- |  | - | - | + | + | + | + |
| 9 | 99-1 | T | - | - | - | - | - | - | - | - | - | N | 00-1 | N | N | N | N | N | N |
|  |  | NO | - | - | - | - | + | + | N | - | - | -- |  | - | ? | + | + | - | - |
| 10 | 99-1 | T | - | - | - | + | + | - | - | - | - | N | 99-1 | N | N | N | N | N | N |
|  |  | NO | - | + | + | + | + | + | N | - | - | -- |  | - | - | - | - | - | - |
| 11 | 99-1 | T | - | - | + | + | + | - | - | - | - | N | 99-1 | N | N | N | N | N | N |
|  |  | NO | - | + | ? | + | + | + | N | - | - | - |  | - | - | - | + | - | - |
| 12 | 99-1 | T | - | - | + | + | ? | - | - | - | - | N | 99-1 | N | N | N | N | N | N |
|  |  | NO | - | + | + | + | + | + | N | - | - | - |  | - | - | - | - | - | - |

FIGURE 32

FIGURE 36

|  | Against 00-1 | Against 99-1 | Against APV-C |
|---|---|---|---|
| 1 infection with 00-1 | 20-60 | < 10 | < 10 |
| 2 infections with 00-1 | >320-1280 | 40-80 | < 10-60 |
| 1 infection with 99-1 | <10-60 | 10-80 | < 10 |
| 2 infections with | 20-40 | 80-400 | <10-40 |

FIGURE 37

+ = positive; - = negative; N = not done; ? = not sure; 0 to 10: days post infection

| nr | 1st infection | 0 | 2 | 3 | 4 | 5 | 6 | 7 | 8 | 9 | 11 | 2nd infection | 0 | 1 | 2 | 3 | 4 | 5 | 7 | 10 |
|---|---|---|---|---|---|---|---|---|---|---|---|---|---|---|---|---|---|---|---|---|
| 3 | 00-1 | - | - | - | + | + | + | + | + | N | - | | - | + | + | + | + | - | ? | - |
| 6 | 00-1 | - | + | + | + | + | + | + | - | - | - | | - | + | + | + | + | + | - | - |

FIGURE 38

FIGURE 39A
FIGURE 39B
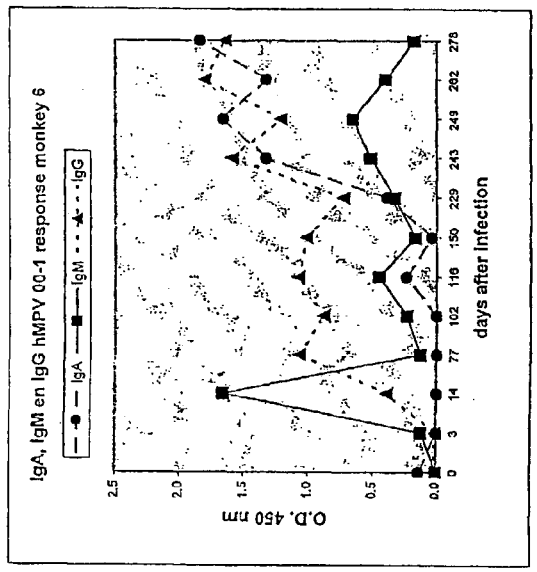
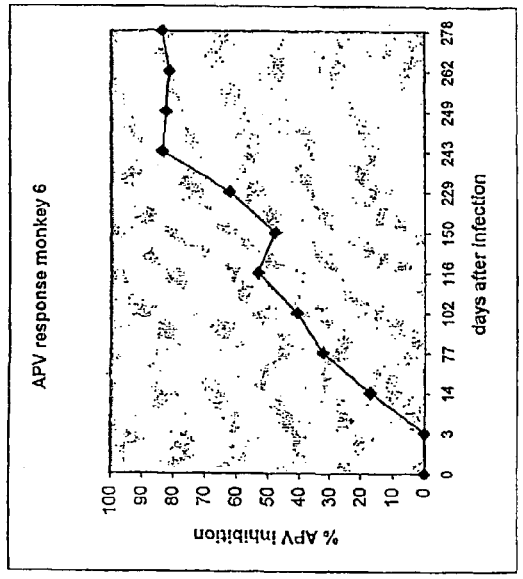
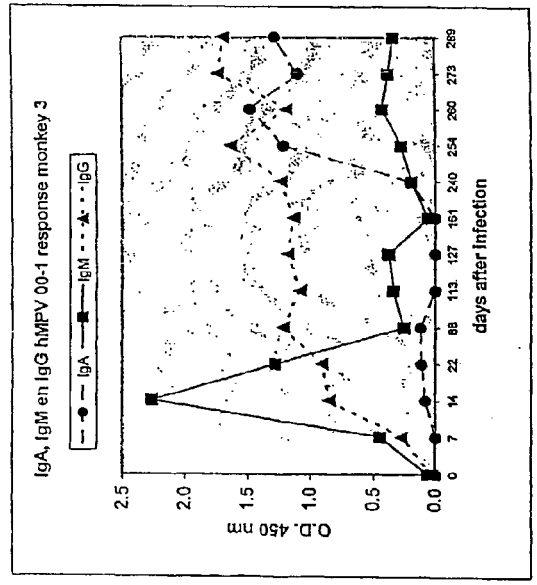
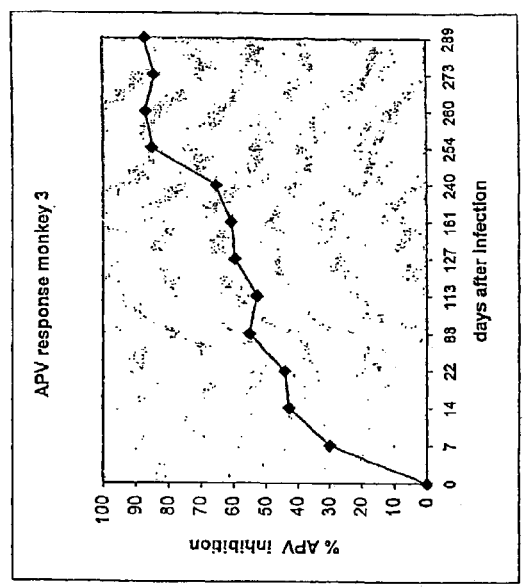

Comparison of two prototypic hMPV isolates with APV-A and APV-C

DNA similarity matrices

| N    | 00-1  | 99-1  | APVC  | APVA  |
|------|-------|-------|-------|-------|
| 00-1 | 1,000 | 0,862 | 0,757 | 0,660 |
| 99-1 | ---   | 1,000 | 0,757 | 0,663 |
| APVC | ---   | ---   | 1,000 | 0,656 |
| APVA | ---   | ---   | ---   | 1,000 |

| P    | 00-1  | 99-1  | APVC  | APVA  |
|------|-------|-------|-------|-------|
| 00-1 | 1,000 | 0,811 | 0,677 | 0,588 |
| 99-1 | ---   | 1,000 | 0,674 | 0,593 |
| APVC | ---   | ---   | 1,000 | 0,584 |
| APVA | ---   | ---   | ---   | 1,000 |

| M    | 00-1  | 99-1  | APVC  | APVA  |
|------|-------|-------|-------|-------|
| 00-1 | 1,000 | 0,865 | 0,766 | 0,695 |
| 99-1 | ---   | 1,000 | 0,773 | 0,707 |
| APVC | ---   | ---   | 1,000 | 0,705 |
| APVA | ---   | ---   | ---   | 1,000 |

| F    | 00-1  | 99-1  | APVC  | APVA  |
|------|-------|-------|-------|-------|
| 00-1 | 1,000 | 0,838 | 0,706 | 0,662 |
| 99-1 | ---   | 1,000 | 0,716 | 0,655 |
| APVC | ---   | ---   | 1,000 | 0,685 |
| APVA | ---   | ---   | ---   | 1,000 |

| M2-1 | 00-1  | 99-1  | APVC  | APVA  |
|------|-------|-------|-------|-------|
| 00-1 | 1,000 | 0,863 | 0,764 | 0,668 |
| 99-1 | ---   | 1,000 | 0,744 | 0,657 |
| APVC | ---   | ---   | 1,000 | 0,670 |
| APVA | ---   | ---   | ---   | 1,000 |

| M2-2 | 00-1  | 99-1  | APVC  | APVA  |
|------|-------|-------|-------|-------|
| 00-1 | 1,000 | 0,861 | 0,648 | 0,486 |
| 99-1 | ---   | 1,000 | 0,675 | 0,486 |
| APVC | ---   | ---   | 1,000 | 0,463 |
| APVA | ---   | ---   | ---   | 1,000 |

FIG.41A

```
SH   00-1   99-1    APVC   APVA
00-1 1.000  0.688   N.A.   0.421
99-1  ---   1.000   N.A.   0.380
APVC  ---    ---    N.A.   N.A.
APVA  ---    ---    ---    1.000

G    00-1   99-1    APVC   APVA
00-1 1.000  0.543   N.A.   0.262
99-1  ---   1.000   N.A.   0.263
APVC  ---    ---    N.A.   N.A.
APVA  ---    ---    ---    1.000

5'L  00-1   99-1    APVC   APVA
00-1 1.000  0.835   N.A.   0.596
99-1  ---   1.000   N.A.   0.605
APVC  ---    ---    N.A.   N.A.
APVA  ---    ---    ---    1.000
```

5'L: only the first 1500 nucleotides of 99-1 were available.
N.A.: sequence not available.

FIG.41B

Protein similarity matrices

```
N   00-1  99-1  APVC  APVA
00-1 1,000 0,949 0,880 0,685
99-1  ---  1,000 0,883 0,682
APVC  ---   ---  1,000 0,700
APVA  ---   ---   ---  1,000

P   00-1  99-1  APVC  APVA
00-1 1,000 0,860 0,683 0,552
99-1  ---  1,000 0,676 0,549
APVC  ---   ---  1,000 0,528
APVA  ---   ---   ---  1,000

M   00-1  99-1  APVC  APVA
00-1 1,000 0,976 0,874 0,775
99-1  ---  1,000 0,874 0,763
APVC  ---   ---  1,000 0,775
APVA  ---   ---   ---  1,000

F   00-1  99-1  APVC  APVA
00-1 1,000 0,938 0,810 0,677
99-1  ---  1,000 0,803 0,674
APVC  ---   ---  1,000 0,719
APVA  ---   ---   ---  1,000

M2-1 00-1  99-1  APVC  APVA
00-1 1,000 0,946 0,844 0,719
99-1  ---  1,000 0,834 0,703
APVC  ---   ---  1,000 0,704
APVA  ---   ---   ---  1,000

M2-2 00-1  99-1  APVC  APVA
00-1 1,000 0,901 0,563 0,246
99-1  ---  1,000 0,577 0,232
APVC  ---   ---  1,000 0,191
APVA  ---   ---   ---  1,000

SH   00-1  99-1  APVC  APVA
00-1 1,000 0,570 N.A.  0,178
99-1  ---  1,000 N.A.  0,162
APVC  ---   ---  N.A.  N.A.
APVA  ---   ---   ---  1,000

G   00-1  99-1  APVC  APVA
00-1 1,000 0,326 N.A.  0,094
99-1  ---  1,000 N.A.  0,107
APVC  ---   ---  N.A.  N.A.
APVA  ---   ---   ---  1,000

5'L  00-1  99-1  APVC  APVA
00-1 1,000 0,921 N.A.  0,600
99-1  ---  1,000 N.A.  0,594
APVC  ---   ---  N.A.  N.A.
APVA  ---   ---   ---  1,000
```

5'L: only the first 500 amino acid residues of 99-1 were available.
N.A.: sequence not available.

FIGURE 42A

Comparison of the coding sequences of 4 hMPV prototypes

| N nt | NL/17/00 | NL/1/99 | NL/1/94 |
|---|---|---|---|
| NL/1/00 | 0.938 | 0.864 | 0.854 |
| NL/17/C0 | | 0.870 | 0.861 |
| NL/1/99 | | | 0.944 |

| N aa | NL/17/00 | NL/1/99 | NL/1/94 |
|---|---|---|---|
| NL/1/00 | 0.994 | 0.954 | 0.961 |
| NL/17/00 | | 0.956 | 0.964 |
| NL/1/99 | | | 0.984 |

| P nt | NL/17/00 | NL/1/99 | NL/1/94 |
|---|---|---|---|
| NL/1/00 | 0.923 | 0.812 | 0.818 |
| NL/17/00 | | 0.807 | 0.811 |
| NL/1/99 | | | 0.932 |

| P aa | NL/17/00 | NL/1/99 | NL/1/94 |
|---|---|---|---|
| NL/1/00 | 0.955 | 0.863 | 0.867 |
| NL/17/00 | | 0.857 | 0.863 |
| NL/1/99 | | | 0.959 |

| M nt | NL/17/00 | NL/1/99 | NL/1/94 |
|---|---|---|---|
| NL/1/00 | 0.938 | 0.860 | 0.861 |
| NL/17/00 | | 0.848 | 0.852 |
| NL/1/99 | | | 0.942 |

| M aa | NL/17/00 | NL/1/99 | NL/1/94 |
|---|---|---|---|
| NL/1/00 | 0.988 | 0.976 | 0.976 |
| NL/17/00 | | 0.972 | 0.972 |
| NL/1/99 | | | 1.000 |

| F nt | NL/17/00 | NL/1/99 | NL/1/94 |
|---|---|---|---|
| NL/1/00 | 0.937 | 0.840 | 0.840 |
| NL/17/00 | | 0.838 | 0.840 |
| NL/1/99 | | | 0.943 |

| F aa | NL/17/00 | NL/1/99 | NL/1/94 |
|---|---|---|---|
| NL/1/00 | 0.979 | 0.940 | 0.946 |
| NL/17/00 | | 0.942 | 0.949 |
| NL/1/99 | | | 0.987 |

| M2 nt | NL/17/00 | NL/1/99 | NL/1/94 |
|---|---|---|---|
| NL/1/00 | 0.943 | 0.854 | 0.854 |
| NL/17/00 | | 0.863 | 0.851 |
| NL/1/99 | | | 0.943 |

| M2.1 nt | NL/17/00 | NL/1/99 | NL/1/94 |
|---|---|---|---|
| NL/1/00 | 0.943 | 0.863 | 0.861 |
| NL/17/00 | | 0.870 | 0.852 |
| NL/1/99 | | | 0.939 |

| M2.1 aa | NL/17/00 | NL/1/99 | NL/1/94 |
|---|---|---|---|
| NL/1/00 | 0.983 | 0.946 | 0.951 |
| NL/17/00 | | 0.951 | 0.957 |
| NL/1/99 | | | 0.978 |

| M2.2 nt | NL/17/00 | NL/1/99 | NL/1/94 |
|---|---|---|---|
| NL/1/00 | 0.953 | 0.861 | 0.865 |
| NL/17/00 | | 0.870 | 0.875 |
| NL/1/99 | | | 0.967 |

| M2.2 aa | NL/17/00 | NL/1/99 | NL/1/94 |
|---|---|---|---|
| NL/1/00 | 0.957 | 0.901 | 0.915 |
| NL/17/00 | | 0.887 | 0.901 |
| NL/1/99 | | | 0.985 |

| SH nt | NL/17/00 | NL/1/99 | NL/1/94 |
|---|---|---|---|
| NL/1/00 | 0.884 | 0.682 | 0.673 |
| NL/17/00 | | 0.688 | 0.685 |
| NL/1/99 | | | 0.887 |

| SH aa | NL/17/00 | NL/1/99 | NL/1/94 |
|---|---|---|---|
| NL/1/00 | 0.836 | 0.570 | 0.576 |
| NL/17/00 | | 0.605 | 0.622 |
| NL/1/99 | | | 0.830 |

| G nt | NL/17/00 | NL/1/99 | NL/1/94 |
|---|---|---|---|
| NL/1/00 | 0.762 | 0.530 | 0.575 |
| NL/17/00 | | 0.573 | 0.546 |
| NL/1/99 | | | 0.765 |

| G aa | NL/17/00 | NL/1/99 | NL/1/94 |
|---|---|---|---|
| NL/1/00 | 0.652 | 0.309 | 0.341 |
| NL/17/00 | | 0.337 | 0.338 |
| NL/1/99 | | | 0.651 |

| L nt | NL/17/00 | NL/1/99 | NL/1/94 |
|---|---|---|---|
| NL/1/00 | 0.944 | 0.843 | 0.843 |
| NL/17/00 | | 0.843 | 0.843 |
| NL/1/99 | | | 0.952 |

| L aa | NL/17/00 | NL/1/99 | NL/1/94 |
|---|---|---|---|
| NL/1/00 | 0.986 | 0.942 | 0.938 |
| NL/17/00 | | 0.944 | 0.939 |
| NL/1/99 | | | 0.985 |

FIGURE 42B

Amino acid sequence alignment of two prototype hMPV isolates

Nucleoprotein (N)

```
              10         20         30         40         50         60
       ....|....|....|....|....|....|....|....|....|....|....|....|
00-1   MSLQGIHLSDLSYKHAILKESQYTIKRDVGTTTAVTPSSLQQEITLLCGEILYAKHADYK  60
99-1   MSLQGIHLSDLSYKHAILKESQYTIKRDVGTTTAVTPSSLQQEITLLCGEILYTKHTDYK  60

70         80         90        100        110        120
       ....|....|....|....|....|....|....|....|....|....|....|....|
00-1   YAAEIGIQYISTALGSERVQQILRNSGSEVQVVLTRTYSLGKIKNNKGEDLQMLDIHGVE 120
99-1   YAAEIGIQYICTALGSERVQQILRNSGSEVQVVLTKTYSLGKGKNSKGEELQMLDIHGVE 120

130        140        150        160        170        180
       ....|....|....|....|....|....|....|....|....|....|....|....|
00-1   KSWVEEIDKEARKTMATLLKESSGNIPQNQRPSAPDTPIILLCVGALIFTKLASTIEVGL 180
99-1   KSWIEEIDKEARKTMVTLLKESSGNIPQNQRPSAPDTPIILLCVGALIFTKLASTIEVGL 180

190        200        210        220        230        240
       ....|....|....|....|....|....|....|....|....|....|....|....|
00-1   ETTVRRANRVLSDALKRYPRMDIPKIARSFYDLFEQKVYHRSLFIEYGKALGSSSTGSKA 240
99-1   ETTVRRANRVLSDALKRYPRIDIPKIARSFYELFEQKVYYRSLFIEYGKALGSSSTGSKA 240

250        260        270        280        290        300
       ....|....|....|....|....|....|....|....|....|....|....|....|
00-1   ESLFVNIFMQAYGAGQTMLRWGVIARSSNNIMLGHVSVQAELKQVTEVYDLVREMGPESG 300
99-1   ESLFVNIFMQAYGAGQTLLRWGVIARSSNNIMLGHVSVQSELKQVTEVYDLVREMGPESG 300

310        320        330        340        350        360
       ....|....|....|....|....|....|....|....|....|....|....|....|
00-1   LLHLRQSPKAGLLSLANCPNFASVVLGNASGLGIIGMYRGRVPNTELFSAAESYAKSLKE 360
99-1   LLHLRQSPKAGLLSLANCPNFASVVLGNASGLGIIGMYRGRVPNTELFSAAESYARSLKE 360

370        380        390
       ....|....|....|....|....|....
00-1   SNKINFSSLGLTDEEKEAAEHFLNVSDDSQNDYE 394
99-1   SNKINFSSLGLTDEEKEAAEHFLNMSGDNQDDYE 394
```

FIGURE 43

Phosphoprotein (P)

```
              10        20        30        40        50        60
         ....|....|....|....|....|....|....|....|....|....|....|....|
00-1     MSFPEGKDILFMGNEAAKLAEAFQKSLRKEGHKRSQSIIGEKVNTVSETLELPTISRPAK 60
99-1     MSFPEGKDILFMGNEAAKIAEAFQKSLKKSGHKRTQSIVGEKVNTISETLELPTISKPAR 60

70        80        90       100       110       120
         ....|....|....|....|....|....|....|....|....|....|....|....|
00-1     PTIPSEPKLAWTDKGGATKTEIKQAIKVMDPIEEEESTEKKVLPSSDGKTPAEKKLKPST 120
99-1     SSTLLEPKLAWADNSGITKITEKPATKTTDPVEEEEFNEKKVLPSSDGKTPAEKKSKPST 120

130       140       150       160       170       180
         ....|....|....|....|....|....|....|....|....|....|....|....|
00-1     NTKKKVSFTGNEPGKYTKLEKDALDLLSDNEEEDAESSILTFEERDTSSLSIEARLESIE 180
99-1     SVKKKVSFTSNEPGKYTKLEKDALDLLSDNEEEDAESSILTFEEKDTSSLSIEARLESIE 180

190       200       210       220       230       240
         ....|....|....|....|....|....|....|....|....|....|....|....|
00-1     EKLSMILGLLRTLNIATAGPTAARDGIRDAMIGVREELIADIIKEAKGKAAEMMEEEMSQ 240
99-1     EKLSMILGLLRTLNIATAGPTAARDGIRDAMIGIREELIAEIIKEAKGKAAEMMEEEMNQ 240

250       260       270       280       290
         ....|....|....|....|....|....|....|....|....|....
00-1     RSKIGNGSVKLTEKAKELNKIVEDESTSGESEEEEEPKDTQDNSQEDDIYQLIM 294
99-1     RSKIGNGSVKLTEKAKELNKIVEDESTSGESEEEEEPKETQDNNQGEDIYQLIM 294
```

FIGURE 44

Matrix protein (M)

```
             10        20        30        40        50        60
     ....|....|....|....|....|....|....|....|....|....|....|....|
00-1 MESYLVDTYQGIPYTAAVQVDLIEKDLLPASLTIWFPLFQANTPPAVLLDQLKTLTITTL 60
99-1 MESYLVDTYQGIPYTAAVQVDLVEKDLLPASLTIWFPLFQANTPPAVLLDQLKTLTITTL 60

70        80        90       100       110       120
     ....|....|....|....|....|....|....|....|....|....|....|....|
00-1 YAASQNGPILKVNASAQGAAMSVLPKKFEVNATVALDEYSKLEFDKLTVCEVKTVYLTTM 120
99-1 YAASQNGPILKVNASAQGAAMSVLPKKFEVNATVALDEYSKLDFDKLTVCDVKTVYLTTM 120

130       140       150       160       170       180
     ....|....|....|....|....|....|....|....|....|....|....|....|
00-1 KPYGMVSKFVSSAKSVGKKTHDLIALCDFMDLEKNTPVTIPAFIKSVSIKESESATVEAA 180
99-1 KPYGMVSKFVSSAKSVGKKTHDLIALCDFMDLEKNIPVTIPAFIKSVSIKESESATVEAA 180

190       200       210       220       230       240
     ....|....|....|....|....|....|....|....|....|....|....|....|
00-1 ISSEADQALTQAKIAPYAGLIMIMTMNNPKGIFKKLGAGTQVIVELGAYVQAESISKICK 240
99-1 ISSEADQALTQAKIAPYAGLIMIMTMNNPKGIFKKLGAGTQVIVELGAYVQAESISRICK 240

250
     ....|....|....
00-1 TWSHQGTRYVLKSR 254
99-1 SWSHQGTRYVLKSR 254
```

FIGURE 45

Fusion protein (F)

```
              10        20        30        40        50        60
        ....|....|....|....|....|....|....|....|....|....|....|....|
00-1    MSWKVVIIFSLLITPQHGLKESYLEESCSTITEGYLSVLRTGWYTNVFTLEVGDVENLTC  60
99-1    MSWKVMIITSLLITPQHGLKESYLEESCSTITEGYLSVLRTGWYTNVFTLEVGDVENLTC  60

70        80        90       100       110       120
        ....|....|....|....|....|....|....|....|....|....|....|....|
00-1    ADGPSLIKTELDLTKSALRELRTVSADQLAREEQIENPRQSRFVLGAIALGVATAAAVTA 120
99-1    TDGPSLIKTELDLTKSALRELKTVSADQLAREEQIENPRQSRFVLGAIALGVATAAAVTA 120

130       140       150       160       170       180
        ....|....|....|....|....|....|....|....|....|....|....|....|
00-1    GVAIAKTIRLESEVTAIKNALKKTNEAVSTLGNGVRVLATAVRELKDFVSKNLTRAINKN 180
99-1    GIAIAKTIRLESEVNAIKGALKQTNEAVSTLGNGVRVLATAVRELKEFVSKNLTSAINRN 180

190       200       210       220       230       240
        ....|....|....|....|....|....|....|....|....|....|....|....|
00-1    KCDIADLKMAVSFSQFNRRFLNVVRQFSDNAGITPAISLDLMTDAELARAVSNMPTSAGQ 240
99-1    KCDIADLKMAVSFSQFNRRFLNVVRQFSDNAGITPAISLDLMTDAELARAVSYMPTSAGQ 240

250       260       270       280       290       300
        ....|....|....|....|....|....|....|....|....|....|....|....|
00-1    IKLMLENRAMVRRKGFGRLIGVYGSSVIYMVQLPIFGVIDTPCWIVKAAPSCSGKKGNYA 300
99-1    IKLMLENRAMVRRKGFGILIGVYGSSVIYMVQLPIFGVIDTPCWIIKAAPSCSEKNGNYA 300

310       320       330       340       350       360
        ....|....|....|....|....|....|....|....|....|....|....|....|
00-1    CLLREDQGWYCQNAGSTVYYPNEKDCETRGDHVFCDTAAGINVAEQSKECNINISTTNYP 360
99-1    CLLREDQGWYCKNAGSTVYYPNEKDCETRGDHVFCDTAAGINVAEQSRECNINISTTNYP 360

370       380       390       400       410       420
        ....|....|....|....|....|....|....|....|....|....|....|....|
00-1    CKVSTGRHPISMVALSPLGALVACYKGVSCSIGSNRVGIIKQLNKGCSYITNQDADTVTI 420
99-1    CKVSTGRHPISMVALSPLGALVACYKGVSCSIGSNWVGIIKQLPKGCSYITNQDADTVTI 420

430       440       450       460       470       480
        ....|....|....|....|....|....|....|....|....|....|....|....|
00-1    DNTVYQLSKVEGEQHVIKGRPVSSSFDPVKFPEDQFNVALDQVFESIENSQALVDQSNRI 480
99-1    DNTVYQLSKVEGEQHVIKGRPVSSSFDPIKFPEDQFNVALDQVFESIENSQALVDQSNKI 480

490       500       510       520       530
        ....|....|....|....|....|....|....|....|....|....|....|....
00-1    LSSAEKGNTGFIIVIILIAVLGSTMILVSVIIIKKTKKPTGAPPELSGVTNNGFIPHN   539
99-1    LNSAEKGNTGFIIVVILVAVLGLTMISVSIIIIKKTRKPTGAPPELNGVTNGGFIPHS   539
```

FIGURE 46

22K protein (M2-1)

```
              10         20         30         40         50         60
     ....|....|....|....|....|....|....|....|....|....|....|....|
00-1 MSRKAPCKYEVRGKCNRGSECKFNHNYWSWPDRYLLIRSNYLLNQLLRNTDRADGLSIIS 60
99-1 MSRKAPCKYEVRGKCNRGSDCKFNHNYWSWPDRYLLLRSNYLLNQLLRNTDKADGLSIIS 60

70         80         90        100        110        120
     ....|....|....|....|....|....|....|....|....|....|....|....|
00-1 GAGREDRTQDFVLGSTNVVQGYIDDNQSITKAAACYSLHNIIKQLQEVEVRQARDNKLSD 120
99-1 GAGREDRTQDFVLGSTNVVQGYIDDNQGITKAAACYSLHNIIKQLQETEVRQARDNKLSD 120

130        140        150        160        170        180
     ....|....|....|....|....|....|....|....|....|....|....|....|
00-1 SKHVALHNLVLSYMEMSKTPASLINNLKRLPREKLKKLAKLIIDLSAGAENDSSYALQDS 180
99-1 SKHVALHNLILSYMEMSKTPASLINNLKKLPREKLKKLARLIIDLSAGTDNDSSYALQDS 180

....|..
00-1 ESTNQVQ 187
99-1 ESTNQVQ 187
```

FIGURE 47

M2-2 protein (M2-2)

```
             10        20        30        40        50        60
     ....|....|....|....|....|....|....|....|....|....|....|....|
00-1 MTLHMPCKTVKALIKCSEHGPVFITIEVDDMIWTHKDLKEALSDGIVKSHTNIYNCYLEN 60
99-1 MTLHMPCKTVKALIKCSKHGPKFITIEADDMIWTHKELKETLSDGIVKSHTNIYSCYLEN 60

70
     ....|....|.
00-1 IEIIYVKAYLS 71
99-1 IEIIYVKTYLS 71
```

FIGURE 48

Short hydrophobic protein (SH)

```
              10         20         30         40         50         60
     ....|....|....|....|....|....|....|....|....|....|....|....|
00-1 MTTLDVIKSDGSSKTCTHLKKIIKDHSGKVLIVLKLILALLTFLTVTITINYIKVENNLQ 60
99-1 MKTLDVIKSDGSSETCNQLKKIIKKHSGKVLIALKLILALLTFFTATITVNYIKVENNLQ 60

70         80         90        100        110        120
     ....|....|....|....|....|....|....|....|....|....|....|....|
00-1 TCQSKTESDKKDSSSNTTSVTTKTTLNHDITQYFKSLIQRYTNSAIN-SDTCWKINRNQC 119
99-1 ACQPKNESDKKVTKNTTSTTIRPTPDPTVVHHLKRLIQRHTNSVTKDSDTCWRIHKNQR 120

130        140        150        160        170        180
     ....|....|....|....|....|....|....|....|....|....|....|....|
00-1 TNITTYKFLCFKSEDTKTNNCDKLTDLCRNKPKPAVGVYHIVECHCIYTVKWRCYHYPTD 179
99-1 TNIKIYKFLCSGFTNSKGTDCEEPTALCDKKLKTIVEKHRKAECHCLHTTEWGCLHP--- 177

00-1 ETQS 183
99-1 ---- 177
```

FIGURE 49

Attachment glycoprotein (G)

```
              10        20        30        40        50        60
         ....|....|....|....|....|....|....|....|....|....|....|....|
00-1     MEVKVENIRTIDMLKARVKNRVARSKCFKNASLVLIGITTLSIALNIYLIINYKMQKNTS  60
99-1     MEVRVENIRAIDMEKAKIKNRIRSSRCYRNATLILIGLTALSMALNIFLIIDHATLRNMI  60

70        80        90       100       110       120
         ....|....|....|....|....|....|....|....|....|....|....|....|
00-1     ESEHHTSSSPMESSRETPTVPTDNSDTNSSPQHPTQQSTEGSTLYFAASASSPETEPTST  120
99-1     KTENCANMPSAEPSKKTPMTSTAGPNTKPNPQQATQTTENSTSPVATPEGHPYTGTTQT  120

130       140       150       160       170       180
         ....|....|....|....|....|....|....|....|....|....|....|....|
00-1     PDTTNRPPFVDTHTTPPSASRTKTSPAVHTKNNERTSSRTHSPPRATTRTARRTTTLRTS  180
99-1     SDTTAPQQTTDKHTAPLKSTNEQITQTTTEKKTIRATTQKREKGKENTNQTTSTAATQTT  180

190       200       210       220       230
         ....|....|....|....|....|....|....|....|....|.
00-1     STRKRPSTASVQPDISATTHKNEEASPASPQTSASTTRIQRKSVEANTSTTYNQTS  236
99-1     NTTNQIRNASET-----ITTSDRPRTDTTQSSEQTTRATDPSSPPHHA--------  224
```

FIGURE 50

N-terminus of polymerase protein (L)

```
                10        20        30        40        50        60
        ....|....|....|....|....|....|....|....|....|....|....|....|
00-1    MDPLNESTVNVYLPDSYLKGVISFSETNAIGSCLLKRPYLKNDNTAKVAIENPVIEHVRL  60
99-1    MDPPCESTVNVYLPDSYLKGVISFSETNAIGSCLLKRPYLKNDNTAKVAVENPVVEHVRL  60

70        80        90       100       110       120
        ....|....|....|....|....|....|....|....|....|....|....|....|
00-1    KNAVNSKMKISDYKIVEPVNMQHEIMKNVHSCELTLLKQFLTRSKNISTLKLNMICDWLQ 120
99-1    RNAVMTKMKISDYKVVEPVNMQHEIMKNIHSCELTLLKQFLTRSKNISSLKLNMICDWLQ 120

130       140       150       160       170       180
        ....|....|....|....|....|....|....|....|....|....|....|....|
00-1    LKSTSDDTSILSFIDVEFIPSWVSNWFSNWYNLNKLILEFRKEEVIRTGSILCRSLGKLV 180
99-1    LKSTSDNTSILNFIDVEFIPVWVSNWFSNWYNLNKLILEFRREEVIRTGSILCRSLGKLV 180

190       200       210       220       230       240
        ....|....|....|....|....|....|....|....|....|....|....|....|
00-1    FVVSSYGCIVKSNKSKRVSFFTYNQLLTWKDVMLSRFNANFCIWVSNSLNENQEGLGLRS 240
99-1    FIVSSYGCVVKSNKSKRVSFFTYNQLLTWKDVMLSRFNANFCIWVSNNLNKNQEGLGLRS 240

250       260       270       280       290       300
        ....|....|....|....|....|....|....|....|....|....|....|....|
00-1    NLQGILTNKLYETVDYMLSLCCNEGFSLVKEFEGFIMSEILRITEHAQFSTRFRNTLLNG 300
99-1    NLQGMLTNKLYETVDYMLSLCCNEGFSLVKEFEGFIMSEILKITEHAQFSTRFRNTLLNG 300

310       320       330       340       350       360
        ....|....|....|....|....|....|....|....|....|....|....|....|
00-1    LTDQLTKLKNKNRIRVHGTVLENNDYPMYEVVLKLLGDTLRCIKLLINKNLENAAELYYI 360
99-1    LTEQLSVLKAKNRSRVLGTILENNNYPMYEVVLKLLGDTLKSIKLLINKNLENAAELYYI 360

370       380       390       400       410       420
        ....|....|....|....|....|....|....|....|....|....|....|....|
00-1    FRIFGHPMVDERDAMDAVKLNNEITKILRWESLTELRGAFILRIIKGFVDNNKRWPKIKN 420
99-1    FRIFGHPMVDEREAMDAVKLNNEITKILKLESLTELRGAFILRIIKGFVDNNKRWPKIKN 420

430       440       450       460       470       480
        ....|....|....|....|....|....|....|....|....|....|....|....|
00-1    LKVLSKRWTMYFKAKSYPSQLELSEQDFLELAAIQFEQEFSVPEKTNLEMVLNDKAISPP 480
99-1    LKVLSKRWAMYFKAKSYPSQLELSVQDFLELAAVQFEQEFSVPEKTNLEMVLNDKAISPP 480

490
        ....|....|....|....
00-1    KRLIWSVYPKNYLPEKIKN  499
99-1    KKLIWSVYPKNYLPETIKN  499
```

FIGURE 51

FIGURE 52

```
              1.........10          .........20          .........30
00-1 1-9000   ----------           -----GTATA           AATTAGATTC
99-1 1-9000   ACGCGAAAAA           AACGCGTATA           AATTAAATTC

.........40          .........50          .........60
00-1 1-9000   CAAAAAAATA           TGGGACAAGT           GAAAATGTCT
99-1 1-9000   CAAACAAA-A           CGGGACAAAT           AAAAATGTCT

.........70          .........80          .........90
00-1 1-9000   CTTCAAGGGA           TTCACCTGAG           TGATTTATCA
99-1 1-9000   CTTCAAGGGA           TTCACCTAAG           TGATCTATCA

.........100         .........110         .........120
00-1 1-9000   TACAAGCATG           CTATATTAAA           AGAGTCTCAG
99-1 1-9000   TATAAACATG           CTATATTAAA           AGAGTCTCAA

.........130         .........140         .........150
00-1 1-9000   TACACAATAA           AAAGAGATGT           GGGTACAACA
99-1 1-9000   TACACAATAA           AAAGAGATGT           AGGCACCACA

.........160         .........170         .........180
00-1 1-9000   ACTGCAGTGA           CACCCTCATC           ATTGCAACAA
99-1 1-9000   ACTGCAGTGA           CACCTTCATC           ATTACAACAA

.........190         .........200         .........210
00-1 1-9000   GAAATAACAC           TGTTGTGTGG           AGAAATTCTG
99-1 1-9000   GAAATAACAC           TTTTGTGTGG           GGAAATACTT

.........220         .........230         .........240
00-1 1-9000   TATGCTAAAC           ATGCTGACTA           CAAATATGCT
99-1 1-9000   TACACTAAAC           ACACTGATTA           CAAATATGCT

.........250         .........260         .........270
00-1 1-9000   GCAGAAATAG           GAATACAATA           TATTAGCACA
99-1 1-9000   GCTGAGATAG           GAATACAATA           TATTTGCACA

.........280         .........290         .........300
00-1 1-9000   GCTTTAGGAT           CAGAGAGAGT           GCAGCAGATT
99-1 1-9000   GCTCTAGGAT           CAGAAAGAGT           ACAACAGATT

.........310         .........320         .........330
00-1 1-9000   CTGAGGAACT           CAGGCAGTGA           AGTCCAAGTG
99-1 1-9000   TTGAGAAACT           CAGGTAGTGA           AGTTCAGGTG

.........340         .........350         .........360
00-1 1-9000   GTCTTAACCA           GAACGTACTC           TCTGGGGAAA
99-1 1-9000   GTTCTAACCA           AAACATACTC           CTTAGGGAAA
```

```
                     . . . . . . . . . . 730           . . . . . . . . . . 740           . . . . . . . . . . 750
00-1 1-9000          TTGTTCATTG                        AGTATGGCAA                        AGCATTAGGC
99-1 1-9000          TTATTCATTG                        AGTACGGAAA                        AGCTTTAGGC

. . . . . . . . . . 760           . . . . . . . . . . 770           . . . . . . . . . . 780
00-1 1-9000          TCATCATCTA                        CAGGCAGCAA                        AGCAGAAAGT
99-1 1-9000          TCATCTTCAA                        CAGGAAGCAA                        AGCAGAAAGT

. . . . . . . . . . 790           . . . . . . . . . . 800           . . . . . . . . . . 810
00-1 1-9000          CTATTTGTTA                        ATATATTCAT                        GCAAGCTTAT
99-1 1-9000          TTGTTTGTAA                        ATATATTTAT                        GCAAGCTTAT

. . . . . . . . . . 820           . . . . . . . . . . 830           . . . . . . . . . . 840
00-1 1-9000          GGGGCCGGTC                        AAACAATGCT                        AAGGTGGGGG
99-1 1-9000          GGAGCTGGCC                        AAACACTGCT                        AAGGTGGGGT

. . . . . . . . . . 850           . . . . . . . . . . 860           . . . . . . . . . . 870
00-1 1-9000          GTCATTGCCA                        GGTCATCCAA                        CAATATAATG
99-1 1-9000          GTCATTGCCA                        GATCATCCAA                        CAACATAATG

. . . . . . . . . . 880           . . . . . . . . . . 890           . . . . . . . . . . 900
00-1 1-9000          TTAGGACATG                        TATCCGTCCA                        AGCTGAGTTA
99-1 1-9000          CTAGGGCATG                        TATCTGTGCA                        ATCTGAATTG

. . . . . . . . . . 910           . . . . . . . . . . 920           . . . . . . . . . . 930
00-1 1-9000          AAACAGGTCA                        CAGAAGTCTA                        TGACTTGGTG
99-1 1-9000          AAGCAAGTTA                        CAGAGGTTTA                        TGACTTGGTG

. . . . . . . . . . 940           . . . . . . . . . . 950           . . . . . . . . . . 960
00-1 1-9000          CGAGAAATGG                        GCCCTGAATC                        TGGACTTCTA
99-1 1-9000          AGAGAAATGG                        GTCCTGAATC                        TGGGCTTTTA

. . . . . . . . . . 970           . . . . . . . . . . 980           . . . . . . . . . . 990
00-1 1-9000          CATTTAAGGC                        AAAGCCCAAA                        AGCTGGACTG
99-1 1-9000          CATCTAAGAC                        AAAGTCCAAA                        GGCAGGGCTG

. . . . . . . . . 1000            . . . . . . . . . 1010            . . . . . . . . . 1020
00-1 1-9000          TTATCACTAG                        CCAACTGTCC                        CAACTTTGCA
99-1 1-9000          TTATCATTGG                        CCAATTGCCC                        CAATTTTGCT

. . . . . . . . . 1030            . . . . . . . . . 1040            . . . . . . . . . 1050
00-1 1-9000          AGTGTTGTTC                        TCGGAAATGC                        CTCAGGCTTA
99-1 1-9000          AGTGTTGTTC                        TTGGCAATGC                        TTCAGGTCTA

. . . . . . . . . 1060            . . . . . . . . . 1070            . . . . . . . . . 1080
00-1 1-9000          GGCATAATCG                        GTATGTATCG                        AGGGAGAGTA
99-1 1-9000          GGCATAATCG                        GAATGTACAG                        AGGGAGAGTA
```

```
                    ........1450 .........1460 .........1470
00-1 1-9000    AACCAACCAT   ACCGTCAGAA   CCAAAGTTAG
99-1 1-9000    GATCATCTAC   ACTGCTGGAA   CCAAAATTGG

........1480 .........1490 .........1500
00-1 1-9000    CATGGACAGA   TAAAGGTGGG   GCAACCAAAA
99-1 1-9000    CATGGGCAGA   CAACAGCGGA   ATCACCAAAA

........1510 .........1520 .........1530
00-1 1-9000    CTGAAATAAA   GCAAGCAATC   AAAGTCATGG
99-1 1-9000    TCACAGAAAA   ACCAGCAACC   AAAACAACAG

........1540 .........1550 .........1560
00-1 1-9000    ATCCCATTGA   AGAAGAAGAG   TCTACCGAGA
99-1 1-9000    ATCCTGTTGA   AGAAGAGGAA   TTCAATGAAA

........1570 .........1580 .........1590
00-1 1-9000    AGAAGGTGCT   ACCCTCCAGT   GATGGGAAAA
99-1 1-9000    AGAAAGTGTT   ACCTTCCAGT   GATGGGAAGA

........1600 .........1610 .........1620
00-1 1-9000    CCCCTGCAGA   AAAGAAACTG   AAACCATCAA
99-1 1-9000    CTCCTGCAGA   GAAAAAATCA   AAGTTTTCAA

........1630 .........1640 .........1650
00-1 1-9000    CTAACACCAA   AAAGAAGGTT   TCATTTACAC
99-1 1-9000    CCAGTGTAAA   AAAGAAAGTT   TCCTTTACAT

........1660 .........1670 .........1680
00-1 1-9000    CAAATGAACC   AGGGAAATAT   ACAAAGTTGG
99-1 1-9000    CAAATGAACC   AGGGAAATAC   ACCAAACTAG

........1690 .........1700 .........1710
00-1 1-9000    AAAAAGATGC   TCTAGATTTG   CTCTCAGATA
99-1 1-9000    AGAAAGATGC   CCTAGATTTG   CTCTCAGACA

........1720 .........1730 .........1740
00-1 1-9000    ATGAAGAAGA   AGATGCAGAA   TCTTCAATCT
99-1 1-9000    ATGAGGAAGA   AGACGCAGAA   TCCTCAATCC

........1750 .........1760 .........1770
00-1 1-9000    TAACCTTTGA   AGAAAGAGAT   ACTTCATCAT
99-1 1-9000    TAACTTTTGA   GGAGAAAGAT   ACATCATCAC

........1780 .........1790 .........1800
00-1 1-9000    TAAGCATTGA   GGCCAGATTG   GAATCAATAG
99-1 1-9000    TAAGCATTGA   AGCTAGACTA   GAATCTATAG
```

FIG.53E

```
                    . . . . . . . . . . 1810       . . . . . . . . . . 1820       . . . . . . . . . . 1830
00-1 1-9000    AGGAGAAATT           AAGCATGATA           TTAGGGCTAT
99-1 1-9000    AAGAGAAGTT           GAGCATGATA           TTAGGACTGC

. . . . . . . . . . 1840       . . . . . . . . . . 1850       . . . . . . . . . . 1860
00-1 1-9000    TAAGAACACT           CAACATTGCT           ACAGCAGGAC
99-1 1-9000    TTCGTACACT           TAACATTGCA           ACAGCAGGAC

. . . . . . . . . . 1870       . . . . . . . . . . 1880       . . . . . . . . . . 1890
00-1 1-9000    CCACAGCAGC           AAGAGATGGG           ATCAGAGATG
99-1 1-9000    CAACAGCTGC           ACGAGATGGA           ATTAGGGATG

. . . . . . . . . . 1900       . . . . . . . . . . 1910       . . . . . . . . . . 1920
00-1 1-9000    CAATGATTGG           CGTAAGAGAG           GAATTAATAG
99-1 1-9000    CAATGATTGG           TATAAGAGAA           GAGCTAATAG

. . . . . . . . . . 1930       . . . . . . . . . . 1940       . . . . . . . . . . 1950
00-1 1-9000    CAGACATAAT           AAAGGAAGCT           AAAGGGAAAG
99-1 1-9000    CAGAGATAAT           TAAGGAAGCC           AAGGGAAAAG

. . . . . . . . . . 1960       . . . . . . . . . . 1970       . . . . . . . . . . 1980
00-1 1-9000    CAGCAGAAAT           GATGGAAGAG           GAAATGAGTC
99-1 1-9000    CAGCTGAAAT           GATGGAAGAA           GAGATGAATC

. . . . . . . . . . 1990       . . . . . . . . . . 2000       . . . . . . . . . . 2010
00-1 1-9000    AACGATCAAA           AATAGGAAAT           GGTAGTGTAA
99-1 1-9000    AAAGTACAAA           AATAGGAAAT           GGCAGTGTAA

. . . . . . . . . . 2020       . . . . . . . . . . 2030       . . . . . . . . . . 2040
00-1 1-9000    AATTAACAGA           AAAAGCAAAA           GAGCTCAACA
99-1 1-9000    AACTAACCGA           GAAGGCAAAA           GAGCTCAACA

. . . . . . . . . . 2050       . . . . . . . . . . 2060       . . . . . . . . . . 2070
00-1 1-9000    AAATTGTTGA           AGATGAAAGC           ACAAGTGGAG
99-1 1-9000    AAATTGTTGA           AGACGAGAGC           ACAAGCGGTG

. . . . . . . . . . 2080       . . . . . . . . . . 2090       . . . . . . . . . . 2100
00-1 1-9000    AATCCGAAGA           AGAAGAAGAA           CCAAAAGACA
99-1 1-9000    AATCAGAAGA           AGAAGAAGAA           CCAAAAGAAA

. . . . . . . . . . 2110       . . . . . . . . . . 2120       . . . . . . . . . . 2130
00-1 1-9000    CACAAGACAA           TAGTCAAGAA           GATGACATTT
99-1 1-9000    CTCAGGATAA           CAATCAAGGA           GAAGATATTT

. . . . . . . . . . 2140       . . . . . . . . . . 2150       . . . . . . . . . . 2160
00-1 1-9000    ACCAGTTAAT           TATGTAGTTT           AATAAAAATA
99-1 1-9000    ATCAGTTAAT           CATGTAGTTT           AATAAAAATA
```

FIG.53F

|          | 2170         | 2180         | 2190         |
|----------|--------------|--------------|--------------|
| 00-1 1-9000 | AACAATGGGA | CAAGTAAAAA | TGGAGTCCTA |
| 99-1 1-9000 | AACAATGGGA | CAAGTCAAGA | TGGAGTCCTA |

|          | 2200         | 2210         | 2220         |
|----------|--------------|--------------|--------------|
| 00-1 1-9000 | CCTAGTAGAC | ACCTATCAAG | GCATTCCTTA |
| 99-1 1-9000 | TCTAGTAGAC | ACTTATCAAG | GCATTCCATA |

|          | 2230         | 2240         | 2250         |
|----------|--------------|--------------|--------------|
| 00-1 1-9000 | CACAGCAGCT | GTTCAAGTTG | ATCTAATAGA |
| 99-1 1-9000 | TACAGCTGCT | GTTCAAGTTG | ACCTGGTAGA |

|          | 2260         | 2270         | 2280         |
|----------|--------------|--------------|--------------|
| 00-1 1-9000 | AAAGGACCTG | TTACCTGCAA | GCCTAACAAT |
| 99-1 1-9000 | AAAAGATTTA | CTGCCAGCAA | GTTTGACAAT |

|          | 2290         | 2300         | 2310         |
|----------|--------------|--------------|--------------|
| 00-1 1-9000 | ATGGTTCCCT | TTGTTTCAGG | CCAACACACC |
| 99-1 1-9000 | ATGGTTTCCT | TTATTTCAGG | CCAACACACC |

|          | 2320         | 2330         | 2340         |
|----------|--------------|--------------|--------------|
| 00-1 1-9000 | ACCAGCAGTG | CTGCTCGATC | AGCTAAAAAC |
| 99-1 1-9000 | ACCAGCAGTT | CTGCTTGATC | AGCTAAAAAC |

|          | 2350         | 2360         | 2370         |
|----------|--------------|--------------|--------------|
| 00-1 1-9000 | CCTGACAATA | ACCACTCTGT | ATGCTGCATC |
| 99-1 1-9000 | CCTGACAATA | ACCACTCTGT | ATGCTGCATC |

|          | 2380         | 2390         | 2400         |
|----------|--------------|--------------|--------------|
| 00-1 1-9000 | ACAAAATGGT | CCAATACTCA | AAGTGAATGC |
| 99-1 1-9000 | ACAGAATGGT | CCAATACTCA | AGGTAAATGC |

|          | 2410         | 2420         | 2430         |
|----------|--------------|--------------|--------------|
| 00-1 1-9000 | ATCAGCCCAA | GGTGCAGCAA | TGTCTGTACT |
| 99-1 1-9000 | ATCTGCCCAA | GGTGCTGCCA | TGTCTGTACT |

|          | 2440         | 2450         | 2460         |
|----------|--------------|--------------|--------------|
| 00-1 1-9000 | TCCCAAAAAA | TTTGAAGTCA | ATGCGACTGT |
| 99-1 1-9000 | TCCCAAAAAA | TTCGAGGTAA | ATGCAACTGT |

|          | 2470         | 2480         | 2490         |
|----------|--------------|--------------|--------------|
| 00-1 1-9000 | AGCACTCGAT | GAATATAGCA | AACTGGAATT |
| 99-1 1-9000 | AGCACTTGAT | GAATACAGTA | AACTTGATTT |

|          | 2500         | 2510         | 2520         |
|----------|--------------|--------------|--------------|
| 00-1 1-9000 | TGACAAACTC | ACAGTCTGTG | AAGTAAAAAC |
| 99-1 1-9000 | TGACAAGCTG | ACGGTCTGCG | ATGTTAAAAC |

FIG.53G

|          | 2530 | 2540 | 2550 |
|---|---|---|---|
| 00-1 1-9000 | AGTTTACTTA | ACAACCATGA | AACCATACGG |
| 99-1 1-9000 | AGTTTATTTG | ACAACTATGA | AACCGTACGG |

|          | 2560 | 2570 | 2580 |
|---|---|---|---|
| 00-1 1-9000 | GATGGTATCA | AAATTTGTGA | GCTCAGCCAA |
| 99-1 1-9000 | GATGGTGTCA | AAATTTGTGA | GTTCAGCCAA |

|          | 2590 | 2600 | 2610 |
|---|---|---|---|
| 00-1 1-9000 | ATCAGTTGGC | AAAAAAACAC | ATGATCTAAT |
| 99-1 1-9000 | ATCAGTTGGC | AAAAAGACAC | ATGATCTAAT |

|          | 2620 | 2630 | 2640 |
|---|---|---|---|
| 00-1 1-9000 | CGCACTATGT | GATTTTATGG | ATCTAGAAAA |
| 99-1 1-9000 | TGCACTATGT | GACTTCATGG | ACCTAGAGAA |

|          | 2650 | 2660 | 2670 |
|---|---|---|---|
| 00-1 1-9000 | GAACACACCT | GTTACAATAC | CAGCATTCAT |
| 99-1 1-9000 | AAATATACCT | GTGACAATAC | CAGCATTCAT |

|          | 2680 | 2690 | 2700 |
|---|---|---|---|
| 00-1 1-9000 | CAAATCAGTT | TCAATCAAAG | AGAGTGAGTC |
| 99-1 1-9000 | AAAGTCAGTT | TCAATCAAAG | AGAGTGAATC |

|          | 2710 | 2720 | 2730 |
|---|---|---|---|
| 00-1 1-9000 | AGCTACTGTT | GAAGCTGCTA | TAAGCAGTGA |
| 99-1 1-9000 | AGCCACTGTT | GAAGCTGCAA | TAAGCAGCGA |

|          | 2740 | 2750 | 2760 |
|---|---|---|---|
| 00-1 1-9000 | AGCAGACCAA | GCTCTAACAC | AGGCCAAAAT |
| 99-1 1-9000 | AGCCGACCAA | GCCTTGACAC | AAGCCAAGAT |

|          | 2770 | 2780 | 2790 |
|---|---|---|---|
| 00-1 1-9000 | TGCACCTTAT | GCGGGATTAA | TTATGATCAT |
| 99-1 1-9000 | TGCGCCCTAT | GCAGGACTAA | TTATGATCAT |

|          | 2800 | 2810 | 2820 |
|---|---|---|---|
| 00-1 1-9000 | GACTATGAAC | AATCCCAAAG | GCATATTCAA |
| 99-1 1-9000 | GACCATGAAC | AATCCAAAAG | GTATATTCAA |

|          | 2830 | 2840 | 2850 |
|---|---|---|---|
| 00-1 1-9000 | AAAGCTTGGA | GCTGGGACTC | AAGTCATAGT |
| 99-1 1-9000 | GAAACTAGGG | GCTGGAACAC | AAGTGATAGT |

|          | 2860 | 2870 | 2880 |
|---|---|---|---|
| 00-1 1-9000 | AGAACTAGGA | GCATCTGTCC | AGGCTGAAAG |
| 99-1 1-9000 | AGAGCTGGGG | GCATATGTTC | AGGCTGAGAG |

FIG.53H

```
                   ........2890 ..........2900 ..........2910
00-1 1-9000    CATAAGCAAA    ATATGCAAGA    CTTGGAGCCA
99-1 1-9000    CATCAGTAGG    ATCTGCAAGA    GCTGGAGTCA

........2920 ..........2930 ..........2940
00-1 1-9000    TCAAGGGACA    AGATATGTCT    TGAAGTCCAG
99-1 1-9000    CCAAGGAACA    AGATACGTAC    TAAAATCCAG

........2950 ..........2960 ..........2970
00-1 1-9000    ATAACAACCA    AGCACCTTGG    CCAAGAGCTA
99-1 1-9000    ATAA-AAATA    ACTGTCTTAA    TCAATAATTG

........2980 ..........2990 ..........3000
00-1 1-9000    CTAACCCTAT    CTCATAGATC    A-TAAAGTCA
99-1 1-9000    CTTATATAAC    TCTAGAGATT    AATAAGCTTA

........3010 ..........3020 ..........3030
00-1 1-9000    CCATTCTAGT    TATATAAAAA    TCAAGTTAGA
99-1 1-9000    TTATTATAGT    TATATAAAAA    T-AAATTAGA

........3040 ..........3050 ..........3060
00-1 1-9000    ACAAGAATTA    AATCAATCAA    GAACGGGACA
99-1 1-9000    ATTAGAAGGG    CATCAATAGA    AAGCGGGACA

........3070 ..........3080 ..........3090
00-1 1-9000    AATAAAAATG    TCTTGGAAAG    TGGTGATCAT
99-1 1-9000    AATAAAAATG    TCTTGGAAAG    TGATGATCAT

........3100 ..........3110 ..........3120
00-1 1-9000    TTTTTCATTG    TTAATAACAC    CTCAACACGG
99-1 1-9000    CATTTCGTTA    CTCATAACAC    CCCAGCACGG

........3130 ..........3140 ..........3150
00-1 1-9000    TCTTAAAGAG    AGCTACTTAG    AAGAGTCATG
99-1 1-9000    GCTAAAGGAG    AGTTATTTGG    AAGAATCATG

........3160 ..........3170 ..........3180
00-1 1-9000    TAGCACTATA    ACTGAAGGAT    ATCTCAGTGT
99-1 1-9000    TAGTACTATA    ACTGAGGGAT    ACCTCAGTGT

........3190 ..........3200 ..........3210
00-1 1-9000    TCTGAGGACA    GGTTGGTACA    CCAATGTTTT
99-1 1-9000    TTTAAGAACA    GGCTGGTACA    CTAATGTCTT

........3220 ..........3230 ..........3240
00-1 1-9000    TACACTGGAG    GTAGGCGATG    TAGAGAACCT
99-1 1-9000    CACATTAGAA    GTTGGTGATG    TTGAAAATCT
```

|  |  | ........3610 | ........3620 | ........3630 |
|---|---|---|---|---|
| 00-1 | 1-9000 | CAAAAACAAG | TGCGACATTG | CTGACCTGAA |
| 99-1 | 1-9000 | CAGGAACAAA | TGTGACATTG | CTGATCTGAA |

|  |  | ........3640 | ........3650 | ........3660 |
|---|---|---|---|---|
| 00-1 | 1-9000 | AATGGCCGTT | AGCTTCAGTC | AATTCAACAG |
| 99-1 | 1-9000 | GATGGCTGTC | AGCTTCAGTC | AATTCAACAG |

|  |  | ........3670 | ........3680 | ........3690 |
|---|---|---|---|---|
| 00-1 | 1-9000 | AAGGTTCCTA | AATGTTGTGC | GGCAATTTTC |
| 99-1 | 1-9000 | AAGATTTCTA | AATGTTGTGC | GGCAGTTTTC |

|  |  | ........3700 | ........3710 | ........3720 |
|---|---|---|---|---|
| 00-1 | 1-9000 | AGACAACGCT | GGAATAACAC | CAGCAATATC |
| 99-1 | 1-9000 | AGACAATGCA | GGGATAACAC | CAGCAATATC |

|  |  | ........3730 | ........3740 | ........3750 |
|---|---|---|---|---|
| 00-1 | 1-9000 | TTTGGACTTA | ATGACAGATG | CTGAACTAGC |
| 99-1 | 1-9000 | ATTGGACCTG | ATGACTGATG | CTGAGTTGGC |

|  |  | ........3760 | ........3770 | ........3780 |
|---|---|---|---|---|
| 00-1 | 1-9000 | CAGAGCTGTT | TCCAACATGC | CAACATCTGC |
| 99-1 | 1-9000 | CAGAGCTGTA | TCATACATGC | CAACATCTGC |

|  |  | ........3790 | ........3800 | ........3810 |
|---|---|---|---|---|
| 00-1 | 1-9000 | AGGACAAATA | AAACTGATGT | TGGAGAACCG |
| 99-1 | 1-9000 | AGGGCAGATA | AAACTGATGT | TGGAGAACCG |

|  |  | ........3820 | ........3830 | ........3840 |
|---|---|---|---|---|
| 00-1 | 1-9000 | TGCAATGGTA | AGAAGAAAAG | GGTTCGGATT |
| 99-1 | 1-9000 | CGCAATGGTA | AGGAGAAAAG | GATTTGGAAT |

|  |  | ........3850 | ........3860 | ........3870 |
|---|---|---|---|---|
| 00-1 | 1-9000 | CCTGATAGGA | GTTTACGGAA | GCTCCGTAAT |
| 99-1 | 1-9000 | CCTGATAGGG | GTCTACGGAA | GCTCTGTGAT |

|  |  | ........3880 | ........3890 | ........3900 |
|---|---|---|---|---|
| 00-1 | 1-9000 | TTACATGGTG | CAACTGCCAA | TCTTTGGGGT |
| 99-1 | 1-9000 | TTACATGGTT | CAATTGCCGA | TCTTTGGTGT |

|  |  | ........3910 | ........3920 | ........3930 |
|---|---|---|---|---|
| 00-1 | 1-9000 | TATAGACACG | CCTTGCTGGA | TAGTAAAAGC |
| 99-1 | 1-9000 | CATAGATACA | CCTTGTTGGA | TCATCAAGGC |

|  |  | ........3940 | ........3950 | ........3960 |
|---|---|---|---|---|
| 00-1 | 1-9000 | AGCCCCTTCT | TGTTCAGGAA | AAAAGGGAAA |
| 99-1 | 1-9000 | AGCTCCCTCT | TGCTCAGAAA | AAAACGGGAA |

FIG.53K

|                | 3970 | 3980 | 3990 |
|---|---|---|---|
| 00-1 1-9000 | CTATGCTTGC | CTCTTAAGAG | AAGACCAAGG |
| 99-1 1-9000 | TTATGCTTGC | CTCCTAAGAG | AGGATCAAGG |

|                | 4000 | 4010 | 4020 |
|---|---|---|---|
| 00-1 1-9000 | ATGGTATTGT | CAAAATGCAG | GGTCAACTGT |
| 99-1 1-9000 | GTGGTATTGT | AAAAATGCAG | GATCTACTGT |

|                | 4030 | 4040 | 4050 |
|---|---|---|---|
| 00-1 1-9000 | TTACTACCCA | AATGAAAAAG | ACTGTGAAAC |
| 99-1 1-9000 | TTACTACCCA | AATGAAAAAG | ACTGCGAAAC |

|                | 4060 | 4070 | 4080 |
|---|---|---|---|
| 00-1 1-9000 | AAGAGGAGAC | CATGTCTTTT | GCGACACAGC |
| 99-1 1-9000 | AAGAGGTGAT | CATGTTTTTT | GTGACACAGC |

|                | 4090 | 4100 | 4110 |
|---|---|---|---|
| 00-1 1-9000 | AGCAGGAATC | AATGTTGCTG | AGCAGTCAAA |
| 99-1 1-9000 | AGCAGGGATC | AATGTTGCTG | AGCAATCAAG |

|                | 4120 | 4130 | 4140 |
|---|---|---|---|
| 00-1 1-9000 | GGAGTGCAAC | ATAAACATAT | CTACTACTAA |
| 99-1 1-9000 | AGAATGCAAC | ATCAACATAT | CTACTACCAA |

|                | 4150 | 4160 | 4170 |
|---|---|---|---|
| 00-1 1-9000 | TTACCCATGC | AAAGTTAGCA | CAGGAAGACA |
| 99-1 1-9000 | CTACCCATGC | AAAGTCAGCA | CAGGAAGACA |

|                | 4180 | 4190 | 4200 |
|---|---|---|---|
| 00-1 1-9000 | TCCTATCAGT | ATGGTTGCAC | TATCTCCTCT |
| 99-1 1-9000 | CCCTATAAGC | ATGGTTGCAC | TATCACCTCT |

|                | 4210 | 4220 | 4230 |
|---|---|---|---|
| 00-1 1-9000 | TGGGGCTTTG | GTTGCTTGCT | ACAAGGGAGT |
| 99-1 1-9000 | CGGTGCTTTG | GTGGCTTGCT | ATAAAGGGGT |

|                | 4240 | 4250 | 4260 |
|---|---|---|---|
| 00-1 1-9000 | GAGCTGTTCC | ATTGGCAGCA | ACAGAGTAGG |
| 99-1 1-9000 | AAGCTGCTCG | ATTGGCAGCA | ATTGGGTTGG |

|                | 4270 | 4280 | 4290 |
|---|---|---|---|
| 00-1 1-9000 | GATCATCAAG | CAACTGAACA | AAGGCTGCTC |
| 99-1 1-9000 | AATCATCAAA | CAATTACCCA | AAGGCTGCTC |

|                | 4300 | 4310 | 4320 |
|---|---|---|---|
| 00-1 1-9000 | TTATATAACC | AACCAAGACG | CAGACACAGT |
| 99-1 1-9000 | ATACATAACC | AACCAGGATG | CAGACACTGT |

FIG.53L

```
                    ........4330  .........4340  .........4350
00-1 1-9000   GACAATAGAC    AACACTGTAT    ACCAGCTAAG
99-1 1-9000   AACAATTGAC    AATACCGTGT    ATCAACTAAG

........4360  .........4370  .........4380
00-1 1-9000   CAAAGTTGAA    GGCGAACAGC    ATGTTATAAA
99-1 1-9000   CAAAGTTGAA    GGTGAACAGC    ATGTAATAAA

........4390  .........4400  .........4410
00-1 1-9000   AGGAAGGCCA    GTGTCAAGCA    GCTTTGACCC
99-1 1-9000   AGGGAGACCA    GTTTCAAGCA    GTTTTGATCC

........4420  .........4430  .........4440
00-1 1-9000   AGTCAAGTTT    CCTGAAGATC    AATTCAATGT
99-1 1-9000   AATCAAGTTT    CCTGAGGATC    AGTTCAATGT

........4450  .........4460  .........4470
00-1 1-9000   TGCACTTGAC    CAAGTTTTCG    AGAGCATTGA
99-1 1-9000   TGCGCTTGAT    CAAGTCTTCG    AAAGCATTGA

........4480  .........4490  .........4500
00-1 1-9000   GAACAGTCAG    GCCTTGGTGG    ATCAATCAAA
99-1 1-9000   GAACAGTCAG    GCACTAGTGG    ACCAGTCAAA

........4510  .........4520  .........4530
00-1 1-9000   CAGAATCCTA    AGCAGTGCAG    AGAAAGGAAA
99-1 1-9000   CAAAATTCTA    AACAGTGCAG    AAAAAGGAAA

........4540  .........4550  .........4560
00-1 1-9000   CACTGGCTTC    ATCATTGTAA    TAATTCTAAT
99-1 1-9000   CACTGGTTTC    ATTATCGTAG    TAATTTTGGT

........4570  .........4580  .........4590
00-1 1-9000   TGCTGTCCTT    GGCTCTACCA    TGATCCTAGT
99-1 1-9000   TGCTGTTCTT    GGTCTAACCA    TGATTTCAGT

........4600  .........4610  .........4620
00-1 1-9000   GAGTGTTTTT    ATCATAATAA    AGAAAACAAA
99-1 1-9000   GAGCATCATC    ATCATAATCA    AGAAAAGAAG

........4630  .........4640  .........4650
00-1 1-9000   GAAACCCACA    GGAGCACCTC    CAGAGCTGAG
99-1 1-9000   GAAGCCCACA    GGAGCACCTC    CAGAGCTGAA

........4660  .........4670  .........4680
00-1 1-9000   TGGTGTCACA    AACAATGGCT    TCATACCACA
99-1 1-9000   TGGTGTCACC    AACGGCGGTT    TCATACCACA
```

FIG.53M

```
              .........4690       .........4700      .........4710
00-1 1-9000  TAATTAGTTA           ATTAAAAATA         AAGTAAATTA
99-1 1-9000  TAGTTAGTTA           ATTAAAAA--         -----A----

.........4720       .........4730      .........4740
00-1 1-9000  AAATAAATTA           AAATTAAAAA         TAAAAATTTG
99-1 1-9000  ----------           ----------         -------TG

.........4750       .........4760      .........4770
00-1 1-9000  GGACAAATCA           TAATGTCTCG         CAAGGCTCCG
99-1 1-9000  GGACAAATCA           TCATGTCTCG         TAAGGCTCCA

.........4780       .........4790      .........4800
00-1 1-9000  TGCAAATATG           AAGTGCGGGG         CAAATGCAAT
99-1 1-9000  TGCAAATATG           AAGTGCGGGG         CAAATGCAAC

.........4810       .........4820      .........4830
00-1 1-9000  AGAGGAAGTG           AGTGCAAGTT         TAACCACAAT
99-1 1-9000  AGAGGGAGTG           ATTGCAAATT         CAATCACAAT

.........4840       .........4850      .........4860
00-1 1-9000  TACTGGAGTT           GGCCAGATAG         ATACTTATTA
99-1 1-9000  TACTGGAGTT           GGCCTGATAG         ATATTTATTG

.........4870       .........4880      .........4890
00-1 1-9000  ATAAGATCAA           ATTATTTATT         AAATCAACTT
99-1 1-9000  TTAAGATCAA           ATTATCTCTT         AAATCAGCTT

.........4900       .........4910      .........4920
00-1 1-9000  TTAAGGAACA           CTGATAGAGC         TGATGGCTTA
99-1 1-9000  TTAAGAAACA           CAGATAAGGC         TGATGGTTTG

.........4930       .........4940      .........4950
00-1 1-9000  TCAATAATAT           CAGGAGCAGG         CAGAGAAGAT
99-1 1-9000  TCAATAATAT           CAGGAGCAGG         TAGAGAAGAT

.........4960       .........4970      .........4980
00-1 1-9000  AGGACACAAG           ATTTTGTCCT         AGGTTCCACC
99-1 1-9000  AGAACTCAAG           ACTTTGTTCT         TGGTTCTACT

.........4990       .........5000      .........5010
00-1 1-9000  AATGTGGTTC           AAGGTTATAT         TGATGATAAC
99-1 1-9000  AATGTGGTTC           AAGGGTACAT         TGATGACAAC

.........5020       .........5030      .........5040
00-1 1-9000  CAAAGCATAA           CAAAAGCTGC         AGCCTGTTAC
99-1 1-9000  CAAGGAATAA           CCAAGGCTGC         AGCTTGCTAT
```

FIG.53N

|              | ..........5050 | ..........5060 | ..........5070 |
|---|---|---|---|
| 00-1 1-9000  | A G T C T A C A T A | A T A T A A T C A A | A C A A C T A C A A |
| 99-1 1-9000  | A G T C T A C A C A | A C A T A A T C A A | G C A A C T A C A A |

|              | ..........5080 | ..........5090 | ..........5100 |
|---|---|---|---|
| 00-1 1-9000  | G A A G T T G A A G | T T A G G C A G G C | T A G A G A T A A C |
| 99-1 1-9000  | G A A A C A G A A G | T A A G A C A G G C | T A G A G A C A A C |

|              | ..........5110 | ..........5120 | ..........5130 |
|---|---|---|---|
| 00-1 1-9000  | A A A C T A T C T G | A C A G C A A A C A | T G T A G C A C T T |
| 99-1 1-9000  | A A G C T T T C T G | A T A G C A A A C A | T G T G G C G C T C |

|              | ..........5140 | ..........5150 | ..........5160 |
|---|---|---|---|
| 00-1 1-9000  | C A C A A C T T A G | T C C T A T C T T A | T A T G G A G A T G |
| 99-1 1-9000  | C A C A A C T T G A | T A T T A T C C T A | T A T G G A G A T G |

|              | ..........5170 | ..........5180 | ..........5190 |
|---|---|---|---|
| 00-1 1-9000  | A G C A A A A C T C | C T G C A T C T T T | A A T C A A C A A T |
| 99-1 1-9000  | A G C A A A A C T C | C T G C A T C T C T | A A T C A A C A A C |

|              | ..........5200 | ..........5210 | ..........5220 |
|---|---|---|---|
| 00-1 1-9000  | C T C A A G A G A C | T G C C G A G A G A | G A A A C T G A A A |
| 99-1 1-9000  | C T A A A G A A A C | T A C C A A G G G A | A A A A C T G A A G |

|              | ..........5230 | ..........5240 | ..........5250 |
|---|---|---|---|
| 00-1 1-9000  | A A A T T A G C A A | A G C T C A T A A T | T G A C T T A T C A |
| 99-1 1-9000  | A A A T T A G C A A | G A T T A A T A A T | T G A T T T A T C A |

|              | ..........5260 | ..........5270 | ..........5280 |
|---|---|---|---|
| 00-1 1-9000  | G C A G G T G C T G | A A A A T G A C T C | T T C A T A T G C C |
| 99-1 1-9000  | G C A G G A A C T G | A C A A T G A C T C | T T C A T A T G C C |

|              | ..........5290 | ..........5300 | ..........5310 |
|---|---|---|---|
| 00-1 1-9000  | T T G C A A G A C A | G T G A A A G C A C | T A A T C A A G T G |
| 99-1 1-9000  | T T G C A A G A C A | G T G A A A G C A C | T A A T C A A G T G |

|              | ..........5320 | ..........5330 | ..........5340 |
|---|---|---|---|
| 00-1 1-9000  | C A G T G A G C A T | G G T C C A G T T T | T C A T T A C T A T |
| 99-1 1-9000  | C A G T A A A C A T | G G T C C C A A A T | T C A T T A C C A T |

|              | ..........5350 | ..........5360 | ..........5370 |
|---|---|---|---|
| 00-1 1-9000  | A G A G G T T G A T | G A C A T G A T A T | G G A C T C A C A A |
| 99-1 1-9000  | A G A G G C A G A T | G A T A T G A T A T | G G A C T C A C A A |

|              | ..........5380 | ..........5390 | ..........5400 |
|---|---|---|---|
| 00-1 1-9000  | G G A C T T A A A A | G A A G C T T T A T | C T G A T G G G A T |
| 99-1 1-9000  | A G A A T T A A A A | G A A A C A C T G T | C T G A T G G G A T |

```
                    .........5770      .........5780      .........5790
00-1 1-9000   ACTACTCTAA        ATCATGATAT        CACACAGTAT
99-1 1-9000   CCCACACCCG        ATCCAACTGT        AGTACATCAT

.........5800      .........5810      .........5820
00-1 1-9000   TTTAAAAGTT        TGATTCAAAG        GTATACAAAC
99-1 1-9000   TTGAAAAGGC        TGATTCAGAG        ACACACCAAC

.........5830      .........5840      .........5850
00-1 1-9000   TCTG---CAA        TAAACAGTGA        CACATGCTGG
99-1 1-9000   TCTGTCACAA        AAGACAGCGA        TACTTGTTGG

.........5860      .........5870      .........5880
00-1 1-9000   AAAATAAACA        GAAATCAATG        CACAAATATA
99-1 1-9000   AGAATACACA        AGAATCAACG        TACAAATATA

.........5890      .........5900      .........5910
00-1 1-9000   ACAACATACA        AATTTTTATG        TTTTAAATCT
99-1 1-9000   AAAATATACA        AGTTCTTATG        CTCTGGGTTC

.........5920      .........5930      .........5940
00-1 1-9000   GAAGACACAA        AAAGGAACAA        TTGTGATAAA
99-1 1-9000   ACAAATTCAA        AAGGTACAGA        TTGTGAGGAA

.........5950      .........5960      .........5970
00-1 1-9000   CTGACAGATT        TATGCAGAAA        CAAACCAAAA
99-1 1-9000   CCAACAGCCC        TATGCGACAA        AAAGTTAAAA

.........5980      .........5990      .........6000
00-1 1-9000   CCAGCAGTTG        GAGTGTATCA        CATAGTAGAA
99-1 1-9000   ACCATAGTAG        AAAAACATAG        AAAAGCAGAA

.........6010      .........6020      .........6030
00-1 1-9000   TGCCATTGTA        TATACACAGT        TAAATGGAAG
99-1 1-9000   TGTCACTGTC        TACATACAAC        CGAGTGGGGG

.........6040      .........6050      .........6060
00-1 1-9000   TGCTATCATT        ACCCAACCGA        TGAAACCCAA
99-1 1-9000   TGCCTTCATC        CCTAAAAT--        ---AACACGG

.........6070      .........6080      .........6090
00-1 1-9000   TCCTAAATGT        TAACACCAGA        TTAGGATCCA
99-1 1-9000   CTTTCAACAT        TAAAATCAGA        ACAACCTCCA

.........6100      .........6110      .........6120
00-1 1-9000   TCCAAGTCTG        TTAGTTCAAC        AATTTAGTTA
99-1 1-9000   CCCAGGTCTA        TCAATACAGT        GGT.TAGCCA
```

```
                    .........7210       .........7220       .........7230
00-1 1-9000  GACAAATAAC         AATGGATCCT         CTCAATGAAT
99-1 1-9000  GATAAATGAC         AATGGATCCC         TTTTGTGAAT

.........7240       .........7250       .........7260
00-1 1-9000  CCACTGTTAA         TGTCTATCTT         CCTGACTCAT
99-1 1-9000  CTACTGTTAA         TGTTTATCTC         CCTGATTCAT

.........7270       .........7280       .........7290
00-1 1-9000  ATCTTAAAGG         AGTGATTTCC         TTTAGTGAGA
99-1 1-9000  ATCTCAAAGG         AGTAATATCT         TTTAGTGAAA

.........7300       .........7310       .........7320
00-1 1-9000  CTAATGCAAT         TGGTTCATGT         CTCTTAAAAA
99-1 1-9000  CCAATGCAAT         TGGATCATGT         CTTTTGAAAA

.........7330       .........7340       .........7350
00-1 1-9000  GACCTTACCT         AAAAAATGAC         AACACTGCAA
99-1 1-9000  GACCCTATCT         AAAAAATGAC         AACACTGCCA

.........7360       .........7370       .........7380
00-1 1-9000  AAGTTGCCAT         AGAGAATCCT         GTTATCGAGC
99-1 1-9000  AAGTTGCTGT         AGAAAACCCT         GTTGTTGAAC

.........7390       .........7400       .........7410
00-1 1-9000  ATGTTAGACT         CAAAAATGCA         GTCAATTCTA
99-1 1-9000  ATGTGAGGCT         TAGAAATGCA         GTCATGACCA

.........7420       .........7430       .........7440
00-1 1-9000  AGATGAAAAT         ATCAGATTAC         AAGATAGTAG
99-1 1-9000  AAATGAAGAT         ATCAGATTAT         AAAGTGGTTG

.........7450       .........7460       .........7470
00-1 1-9000  AGCCAGTAAA         CATGCAACAT         GAAATTATGA
99-1 1-9000  AACCAGTTAA         TATGCAGCAT         GAAATAATGA

.........7480       .........7490       .........7500
00-1 1-9000  AGAATGTACA         CAGTTGTGAG         CTCACATTAT
99-1 1-9000  AAAATATACA         TAGTTGTGAG         CTTACATTAT

.........7510       .........7520       .........7530
00-1 1-9000  TAAAACAGTT         TTTAACAAGG         AGTAAAAATA
99-1 1-9000  TAAAACAATT         CTTAACGAGA         AGCAAAAACA

.........7540       .........7550       .........7560
00-1 1-9000  TTAGCACTCT         CAAATTAAAT         ATGATATGTG
99-1 1-9000  TTAGCTCTCT         AAAATTAAAT         ATGATATGTG
```

FIG.53U

```
                    . . . . . . . . . . 7570 . . . . . . . . . . 7580 . . . . . . . . . . 7590
00-1 1-9000   ATTGGCTGCA        GTTAAAGTCT        ACATCAGATG
99-1 1-9000   ATTGGTTACA        GTTAAAATCC        ACTTCAGATA

. . . . . . . . . . 7600 . . . . . . . . . . 7610 . . . . . . . . . . 7620
00-1 1-9000   ATACCTCAAT        CCTAAGTTTT        ATAGATGTAG
99-1 1-9000   ACACATCAAT        TCTCAATTTT        ATAGATGTGG

. . . . . . . . . . 7630 . . . . . . . . . . 7640 . . . . . . . . . . 7650
00-1 1-9000   AATTTATACC        TAGCTGGGTA        AGCAATTGGT
99-1 1-9000   AGTTCATACC        CGTTTGGGTA        AGCAATTGGT

. . . . . . . . . . 7660 . . . . . . . . . . 7670 . . . . . . . . . . 7680
00-1 1-9000   TTAGTAATTG        GTACAATCTC        AACAAGTTGA
99-1 1-9000   TCAGTAACTG        GTATAATCTC        AATAAATTAA

. . . . . . . . . . 7690 . . . . . . . . . . 7700 . . . . . . . . . . 7710
00-1 1-9000   TTCTGGAATT        CAGGAAAGAA        GAAGTAATAA
99-1 1-9000   TCTTAGAGTT        TAGAAGAGAA        GAAGTAATAA

. . . . . . . . . . 7720 . . . . . . . . . . 7730 . . . . . . . . . . 7740
00-1 1-9000   GAACTGGTTC        AATCTTGTGT        AGGTCATTGG
99-1 1-9000   GAACTGGTTC        AATTTTATGT        AGATCACTAG

. . . . . . . . . . 7750 . . . . . . . . . . 7760 . . . . . . . . . . 7770
00-1 1-9000   GTAAATTAGT        TTTTGTTGTA        TCATCATATG
99-1 1-9000   GCAAGTTAGT        TTTTATTGTA        TCATCTTATG

. . . . . . . . . . 7780 . . . . . . . . . . 7790 . . . . . . . . . . 7800
00-1 1-9000   GATGTATAGT        CAAGAGCAAC        AAAAGCAAAA
99-1 1-9000   GATGTGTAGT        AAAAAGCAAC        AAAAGTAAAA

. . . . . . . . . . 7810 . . . . . . . . . . 7820 . . . . . . . . . . 7830
00-1 1-9000   GAGTGAGCTT        CTTCACATAC        AATCAACTGT
99-1 1-9000   GAGTGAGCTT        TTTCACCTAT        AACCAACTGT

. . . . . . . . . . 7840 . . . . . . . . . . 7850 . . . . . . . . . . 7860
00-1 1-9000   TAACATGGAA        AGATGTGATG        TTAAGTAGAT
99-1 1-9000   TAACATGGAA        AGATGTGATG        TTAAGTAGAT

. . . . . . . . . . 7870 . . . . . . . . . . 7880 . . . . . . . . . . 7890
00-1 1-9000   TCAATGCAAA        TTTTTGTATA        TGGGTAAGCA
99-1 1-9000   TCAATGCAAA        CTTTTGTATA        TGGGTAAGTA

. . . . . . . . . . 7900 . . . . . . . . . . 7910 . . . . . . . . . . 7920
00-1 1-9000   ACAGTCTGAA        TGAAAATCAA        GAAGGGCTAG
99-1 1-9000   ACAACCTGAA        CAAAAATCAA        GAAGGACTAG
```

|                    | 1 . . . . . . . 10 | . . . . . . . . 20 | . . . . . . . . 30 |
|--------------------|--------------------|--------------------|--------------------|
| 00-1 7001-13350    | ACAATGGAGA         | AGCCAAAAGA         | CAATTCACAA         |
| 99-1 7001-13294    | - - - - - - - - - -| - - - - - - - - - -| - - - - - - - - - -|

|                    | . . . . . . . . 40 | . . . . . . . . 50 | . . . . . . . . 60 |
|--------------------|--------------------|--------------------|--------------------|
| 00-1 7001-13350    | TCTCCCCAAA         | AAGGCAACAA         | CACCATATTA         |
| 99-1 7001-13294    | - - - - - - - - - -| - AAACATAGA        | CACCATATGG         |

|                    | . . . . . . . . 70 | . . . . . . . . 80 | . . . . . . . . 90 |
|--------------------|--------------------|--------------------|--------------------|
| 00-1 7001-13350    | - - - GCTCTGC      | CCAAATCTCC         | GTGGAAAAAA         |
| 99-1 7001-13294    | AAGGTTCTAG         | CATATGCACC         | AATGAGATGG         |

|                    | . . . . . . . . 100| . . . . . . . . 110| . . . . . . . . 120|
|--------------------|--------------------|--------------------|--------------------|
| 00-1 7001-13350    | CACTCGCCCA         | TATACCAAAA         | ATACCACAAC         |
| 99-1 7001-13294    | CATCTGTTCA         | TGTATCAATA         | GCACCACCAT         |

|                    | . . . . . . . . 130| . . . . . . . . 140| . . . . . . . . 150|
|--------------------|--------------------|--------------------|--------------------|
| 00-1 7001-13350    | CACCCCAAGA         | AAAAAACTGG         | GCAAAACAAC         |
| 99-1 7001-13294    | CATTCAAGGA         | ATAAGAAGAG         | GCGAAA - - - -     |

|                    | . . . . . . . . 160| . . . . . . . . 170| . . . . . . . . 180|
|--------------------|--------------------|--------------------|--------------------|
| 00-1 7001-13350    | ACCCAAGAGA         | CAAATAACAA         | TGGATCCTCT         |
| 99-1 7001-13294    | ATTTAAGGGA         | TAAATGACAA         | TGGATCCCTT         |

|                    | . . . . . . . . 190| . . . . . . . . 200| . . . . . . . . 210|
|--------------------|--------------------|--------------------|--------------------|
| 00-1 7001-13350    | CAATGAATCC         | ACTGTTAATG         | TCTATCTTCC         |
| 99-1 7001-13294    | TTGTGAATCT         | ACTGTTAATG         | TTTATCTCCC         |

|                    | . . . . . . . . 220| . . . . . . . . 230| . . . . . . . . 240|
|--------------------|--------------------|--------------------|--------------------|
| 00-1 7001-13350    | TGACTCATAT         | CTTAAAGGAG         | TGATTTCCTT         |
| 99-1 7001-13294    | TGATTCATAT         | CTCAAAGGAG         | TAATATCTTT         |

|                    | . . . . . . . . 250| . . . . . . . . 260| . . . . . . . . 270|
|--------------------|--------------------|--------------------|--------------------|
| 00-1 7001-13350    | TAGTGAGACT         | AATGCAATTG         | GTTCATGTCT         |
| 99-1 7001-13294    | TAGTGAAACC         | AATGCAATTG         | GATCATGTCT         |

|                    | . . . . . . . . 280| . . . . . . . . 290| . . . . . . . . 300|
|--------------------|--------------------|--------------------|--------------------|
| 00-1 7001-13350    | CTTAAAAAGA         | CCTTACCTAA         | AAAATGACAA         |
| 99-1 7001-13294    | TTTGAAAAGA         | CCCTATCTAA         | AAAATGACAA         |

|                    | . . . . . . . . 310| . . . . . . . . 320| . . . . . . . . 330|
|--------------------|--------------------|--------------------|--------------------|
| 00-1 7001-13350    | CACTGCAAAA         | GTTGCCATAG         | AGAATCCTGT         |
| 99-1 7001-13294    | CACTGCCAAA         | GTTGCTGTAG         | AAAACCCTGT         |

|                    | . . . . . . . . 340| . . . . . . . . 350| . . . . . . . . 360|
|--------------------|--------------------|--------------------|--------------------|
| 00-1 7001-13350    | TATCGAGCAT         | GTTAGACTCA         | AAAATGCAGT         |
| 99-1 7001-13294    | TGTTGAACAT         | GTGAGGCTTA         | GAAATGCAGT         |

|  |  | . . . . . . . . . 1450 | . . . . . . . . . 1460 | . . . . . . . . . 1470 |
|---|---|---|---|---|
| 00-1 | 7001-13350 | TAGTAAGAGA | TGGACTATGT | ACTTCAAAGC |
| 99-1 | 7001-13294 | CAGCAAAAGA | TGGGCTATGT | ATTTCAAAGC |

|  |  | . . . . . . . . . 1480 | . . . . . . . . . 1490 | . . . . . . . . . 1500 |
|---|---|---|---|---|
| 00-1 | 7001-13350 | AAAAAGTTAC | CCCAGTCAAC | TTGAATTAAG |
| 99-1 | 7001-13294 | TAAAAGTTAC | CCTAGCCAAC | TTGAGCTAAG |

|  |  | . . . . . . . . . 1510 | . . . . . . . . . 1520 | . . . . . . . . . 1530 |
|---|---|---|---|---|
| 00-1 | 7001-13350 | CGAACAAGAT | TTTTTAGAGC | TTGCTGCAAT |
| 99-1 | 7001-13294 | TGTACAAGAT | TTTTTAGAAC | TTGCTGCAGT |

|  |  | . . . . . . . . . 1540 | . . . . . . . . . 1550 | . . . . . . . . . 1560 |
|---|---|---|---|---|
| 00-1 | 7001-13350 | ACAGTTTGAA | CAAGAGTTTT | CTGTCCCTGA |
| 99-1 | 7001-13294 | ACAATTTGAG | CAGGAATTCT | CTGTACCTGA |

|  |  | . . . . . . . . . 1570 | . . . . . . . . . 1580 | . . . . . . . . . 1590 |
|---|---|---|---|---|
| 00-1 | 7001-13350 | AAAAACCAAC | CTTGAGATGG | TATTAAATGA |
| 99-1 | 7001-13294 | AAAAACCAAC | CTTGAGATGG | TATTAAATGA |

|  |  | . . . . . . . . . 1600 | . . . . . . . . . 1610 | . . . . . . . . . 1620 |
|---|---|---|---|---|
| 00-1 | 7001-13350 | TAAAGCTATA | TCACCTCCTA | AAAGATTAAT |
| 99-1 | 7001-13294 | TAAAGCAATA | TCACCTCCAA | AAAAGCTAAT |

|  |  | . . . . . . . . . 1630 | . . . . . . . . . 1640 | . . . . . . . . . 1650 |
|---|---|---|---|---|
| 00-1 | 7001-13350 | ATGGTCTGTG | TATCCAAAAA | ATTACTTACC |
| 99-1 | 7001-13294 | ATGGTCTGTA | TATCCAAAAA | ACTACCTGCC |

|  |  | . . . . . . . . . 1660 | . . . . . . . . . 1670 | . . . . . . . . . 1680 |
|---|---|---|---|---|
| 00-1 | 7001-13350 | TGAGAAAATA | AAAAATCGAT | ATCTAGAAGA |
| 99-1 | 7001-13294 | TGAAACTATA | AAAAATCAAT | ATTTAGAAGA |

|  |  | . . . . . . . . . 1690 | . . . . . . . . . 1700 | . . . . . . . . . 1710 |
|---|---|---|---|---|
| 00-1 | 7001-13350 | GACTTTCAAT | GCAAGTGATA | GTCTCAAAAC |
| 99-1 | 7001-13294 | GGCTTTCAAT | GCAAGTGACA | GCCAAAGAAC |

|  |  | . . . . . . . . . 1720 | . . . . . . . . . 1730 | . . . . . . . . . 1740 |
|---|---|---|---|---|
| 00-1 | 7001-13350 | AAGAAGAGTA | CTAGAGTACT | ATTTGAAAGA |
| 99-1 | 7001-13294 | AAGGAGAGTC | TTAGAATTTT | ACTTAAAAGA |

|  |  | . . . . . . . . . 1750 | . . . . . . . . . 1760 | . . . . . . . . . 1770 |
|---|---|---|---|---|
| 00-1 | 7001-13350 | TAATAAATTC | GACCAAAAAG | AACTTAAAAG |
| 99-1 | 7001-13294 | TTGTAAATTT | GATCAAAAAG | AACTTAAACG |

|  |  | . . . . . . . . . 1780 | . . . . . . . . . 1790 | . . . . . . . . . 1800 |
|---|---|---|---|---|
| 00-1 | 7001-13350 | TTATGTTGTT | AAACAAGAAT | ATTTAAATGA |
| 99-1 | 7001-13294 | TTATGTAATT | AAACAAGAGT | ATCTGAATGA |

FIG.53AE

|  | 1810 | 1820 | 1830 |
|---|---|---|---|
| 00-1 7001-13350 | TAAGGATCAT | ATTGTCTCGC | TAACTGGAAA |
| 99-1 7001-13294 | CAAAGACCAC | ATTGTCTCGT | TAACTGGGAA |

|  | 1840 | 1850 | 1860 |
|---|---|---|---|
| 00-1 7001-13350 | AGAAAGAGAA | TTAAGTGTAG | GTAGAATGTT |
| 99-1 7001-13294 | GGAAAGAGAA | TTAAGTGTAG | GTAGGATGTT |

|  | 1870 | 1880 | 1890 |
|---|---|---|---|
| 00-1 7001-13350 | TGCTATGCAA | CCAGGAAAAC | AGCGACAAAT |
| 99-1 7001-13294 | TGCAATGCAA | CCAGGAAAAC | AAAGACAGAT |

|  | 1900 | 1910 | 1920 |
|---|---|---|---|
| 00-1 7001-13350 | ACAAATATTG | GCTGAAAAAT | TGTTAGCTGA |
| 99-1 7001-13294 | ACAGATATTA | GCTGAGAAAC | TTCTAGCTGA |

|  | 1930 | 1940 | 1950 |
|---|---|---|---|
| 00-1 7001-13350 | TAATATTGTA | CCTTTTTTAA | CAGAAACCTT |
| 99-1 7001-13294 | TAATATTGTA | CCTTTTTTCC | CAGAAACTTT |

|  | 1960 | 1970 | 1980 |
|---|---|---|---|
| 00-1 7001-13350 | AACAAAGTAT | GGTGATCTAG | ATCTTCAGAG |
| 99-1 7001-13294 | AACAAAGTAT | GGTGACTTAG | ATCTCCAAAG |

|  | 1990 | 2000 | 2010 |
|---|---|---|---|
| 00-1 7001-13350 | AATAATGGAA | ATCAAATCGG | AACTTTCTTC |
| 99-1 7001-13294 | AATTATGGAA | ATAAAATCAG | AACTTTCTTC |

|  | 2020 | 2030 | 2040 |
|---|---|---|---|
| 00-1 7001-13350 | TATTAAAACT | AGAAGAAATG | ATAGTTATAA |
| 99-1 7001-13294 | CATTAAAACT | AGAAAGAATG | ATAGCTACAA |

|  | 2050 | 2060 | 2070 |
|---|---|---|---|
| 00-1 7001-13350 | TAATTACATT | GCAAGAGCAT | CCATAGTAAC |
| 99-1 7001-13294 | CAATTATATT | GCAAGGGCCT | CTATAGTAAC |

|  | 2080 | 2090 | 2100 |
|---|---|---|---|
| 00-1 7001-13350 | AGATTTAAGT | AAGTTCAACC | AAGCCTTTAG |
| 99-1 7001-13294 | AGACTTAAGT | AAGTTCAATC | AGGCCTTTAG |

|  | 2110 | 2120 | 2130 |
|---|---|---|---|
| 00-1 7001-13350 | GTATGAAACT | ACAGCGATCT | GTGCGGATGT |
| 99-1 7001-13294 | ATATGAAACC | ACAGCTATAT | GTGCAGATGT |

|  | 2140 | 2150 | 2160 |
|---|---|---|---|
| 00-1 7001-13350 | AGCAGATGAA | CTACATGGAA | CACAAAGCCT |
| 99-1 7001-13294 | AGCTGATGAG | TTACATGGGA | CACAAAGCTT |

FIG.53AF

|  | | 2170 | | 2180 | | 2190 |
|---|---|---|---|---|---|---|
| 00-1 7001-13350 | ATTCTGTTGG | TTACATCTTA | TCGTCCCTAT |
| 99-1 7001-13294 | ATTCTGTTGG | TTACATCTTA | TTGTTCCCAT |

|  | | 2200 | | 2210 | | 2220 |
|---|---|---|---|---|---|---|
| 00-1 7001-13350 | GACAACAATG | ATATGTGCCT | ATAGACATGC |
| 99-1 7001-13294 | GACTACAATG | ATATGTGCAT | ACAGACATGC |

|  | | 2230 | | 2240 | | 2250 |
|---|---|---|---|---|---|---|
| 00-1 7001-13350 | ACCACCAGAA | ACAAAAGGTG | AATATGATAT |
| 99-1 7001-13294 | ACCACCAGAA | ACAAAAGGGG | AATATGATAT |

|  | | 2260 | | 2270 | | 2280 |
|---|---|---|---|---|---|---|
| 00-1 7001-13350 | AGATAAGATA | GAAGAGCAAA | GTGGTTTATA |
| 99-1 7001-13294 | AGACAAAATA | CAAGAGCAAA | GCGGATTATA |

|  | | 2290 | | 2300 | | 2310 |
|---|---|---|---|---|---|---|
| 00-1 7001-13350 | TAGATATCAT | ATGGGTGGTA | TTGAAGGATG |
| 99-1 7001-13294 | CAGATATCAT | ATGGGAGGGA | TTGAAGGGTG |

|  | | 2320 | | 2330 | | 2340 |
|---|---|---|---|---|---|---|
| 00-1 7001-13350 | GTGTCAAAAA | CTCTGGACAA | TGGAAGCTAT |
| 99-1 7001-13294 | GTGCCAGAAG | TTATGGACAA | TGGAAGCAAT |

|  | | 2350 | | 2360 | | 2370 |
|---|---|---|---|---|---|---|
| 00-1 7001-13350 | ATCTCTATTA | GATGTTGTAT | CTGTAAAAAC |
| 99-1 7001-13294 | ATCCTTGTTA | GATGTAGTAT | CTGTGAAGAC |

|  | | 2380 | | 2390 | | 2400 |
|---|---|---|---|---|---|---|
| 00-1 7001-13350 | ACGATGTCAA | ATGACATCTT | TATTAAACGG |
| 99-1 7001-13294 | TCGCTGTCAG | ATGACCTCTC | TATTAAACGG |

|  | | 2410 | | 2420 | | 2430 |
|---|---|---|---|---|---|---|
| 00-1 7001-13350 | TGACAACCAA | TCAATAGATG | TAAGTAAACC |
| 99-1 7001-13294 | AGACAATCAG | TCAATAGATG | TTAGTAAACC |

|  | | 2440 | | 2450 | | 2460 |
|---|---|---|---|---|---|---|
| 00-1 7001-13350 | AGTTAAGTTA | TCTGAGGGTT | TAGATGAAGT |
| 99-1 7001-13294 | AGTAAAATTG | TCTGAAGGTA | TAGATGAAGT |

|  | | 2470 | | 2480 | | 2490 |
|---|---|---|---|---|---|---|
| 00-1 7001-13350 | GAAAGCAGAT | TATAGCTTGG | CTGTAAAAAT |
| 99-1 7001-13294 | AAAAGCAGAC | TATAGCTTAG | CAATTAGAAT |

|  | | 2500 | | 2510 | | 2520 |
|---|---|---|---|---|---|---|
| 00-1 7001-13350 | GTTAAAAGAA | ATAAGAGATG | CATACAGAAA |
| 99-1 7001-13294 | GCTTAAAGAA | ATAAGAGATG | CTTATAAAAA |

FIG.53AG

|            |               | ..........2530 | ..........2540 | ..........2550 |
|------------|---------------|----------------|----------------|----------------|
| 00-1       | 7001-13350    | TATAGGCCAT     | AAACTTAAAG     | AAGGGGAAAC     |
| 99-1       | 7001-13294    | CATTGGTCAT     | AAACTCAAAG     | AAGGTGAAAC     |

|            |               | ..........2560 | ..........2570 | ..........2580 |
|------------|---------------|----------------|----------------|----------------|
| 00-1       | 7001-13350    | ATATATATCA     | AGAGATCTTC     | AGTTTATAAG     |
| 99-1       | 7001-13294    | ATATATATCA     | AGGGATCTCC     | AATTTATAAG     |

|            |               | ..........2590 | ..........2600 | ..........2610 |
|------------|---------------|----------------|----------------|----------------|
| 00-1       | 7001-13350    | TAAGGTGATT     | CAATCTGAAG     | GAGTAATGCA     |
| 99-1       | 7001-13294    | TAAGGTGATT     | CAATCTGAAG     | GAGTCATGCA     |

|            |               | ..........2620 | ..........2630 | ..........2640 |
|------------|---------------|----------------|----------------|----------------|
| 00-1       | 7001-13350    | TCCTACCCCT     | ATAAAAAGA      | TCTTAAGAGT     |
| 99-1       | 7001-13294    | TCCTACCCCT     | ATAAAAAGA      | TATTAAGAGT     |

|            |               | ..........2650 | ..........2660 | ..........2670 |
|------------|---------------|----------------|----------------|----------------|
| 00-1       | 7001-13350    | GGGACCATGG     | ATAAACACAA     | TATTAGATGA     |
| 99-1       | 7001-13294    | AGGTCCTTGG     | ATAAATACAA     | TACTAGATGA     |

|            |               | ..........2680 | ..........2690 | ..........2700 |
|------------|---------------|----------------|----------------|----------------|
| 00-1       | 7001-13350    | CATTAAAACC     | AGTGCAGAGT     | CAATAGGGAG     |
| 99-1       | 7001-13294    | TATTAAAACC     | AGTGCAGAAT     | CAATAGGAAG     |

|            |               | ..........2710 | ..........2720 | ..........2730 |
|------------|---------------|----------------|----------------|----------------|
| 00-1       | 7001-13350    | TCTATGTCAG     | GAATTAGAAT     | TTAGGGGGGA     |
| 99-1       | 7001-13294    | TCTATGTCAA     | GAACTAGAAT     | TCAGAGGGGA     |

|            |               | ..........2740 | ..........2750 | ..........2760 |
|------------|---------------|----------------|----------------|----------------|
| 00-1       | 7001-13350    | AAGCATAATA     | GTTAGTCTGA     | TATTAAGGAA     |
| 99-1       | 7001-13294    | GAGTATACTA     | GTTAGCTTGA     | TATTAAGGAA     |

|            |               | ..........2770 | ..........2780 | ..........2790 |
|------------|---------------|----------------|----------------|----------------|
| 00-1       | 7001-13350    | TTTTTGGCTG     | TATAATTTAT     | ACATGCATGA     |
| 99-1       | 7001-13294    | TTTCTGGCTG     | TATAACTTGT     | ACATGTATGA     |

|            |               | ..........2800 | ..........2810 | ..........2820 |
|------------|---------------|----------------|----------------|----------------|
| 00-1       | 7001-13350    | ATCAAAGCAA     | CACCCCCTAG     | CAGGGAAGCA     |
| 99-1       | 7001-13294    | GTCAAAACAG     | CACCCATTAG     | CTGGGAAGCA     |

|            |               | ..........2830 | ..........2840 | ..........2850 |
|------------|---------------|----------------|----------------|----------------|
| 00-1       | 7001-13350    | GTTATTCAAA     | CAACTAAATA     | AAACATTAAC     |
| 99-1       | 7001-13294    | ACTGTTCAAG     | CAATTGAACA     | AAACATTAAC     |

|            |               | ..........2860 | ..........2870 | ..........2880 |
|------------|---------------|----------------|----------------|----------------|
| 00-1       | 7001-13350    | ATCAGTGCAG     | AGATTTTTTG     | AAATAAAAAA     |
| 99-1       | 7001-13294    | ATCTGTGCAG     | AGATTTTTTG     | AACTGAAGAA     |

```
                            .........3970   .........3980   .........3990
00-1 7001-13350   GTTATCTGTC      AGTAGTAGAC      CTATGGAATT
99-1 7001-13294   GTTATCTGTT      AGTAGTAGAC      CCATGGAATT

.........4000   .........4010   .........4020
00-1 7001-13350   CCCAGCATCA      GTTCCAGCTT      ATAGAACAAC
99-1 7001-13294   CCCAGCTTCT      GTTCCAGCTT      ACAGGACAAC

.........4030   .........4040   .........4050
00-1 7001-13350   AAATTACCAT      TTTGACACTA      GTCCTATTAA
99-1 7001-13294   AAATTACCAT      TTTGACACTA      GTCCAATCAA

.........4060   .........4070   .........4080
00-1 7001-13350   TCAAGCACTA      AGTGAGAGAT      TTGGGAATGA
99-1 7001-13294   CCAAGCATTA      AGTGAGAGGT      TCGGGAACGA

.........4090   .........4100   .........4110
00-1 7001-13350   AGATATTAAT      TTGGTCTTCC      AAAATGCAAT
99-1 7001-13294   AGACATTAAT      TTAGTGTTCC      AAAATGCAAT

.........4120   .........4130   .........4140
00-1 7001-13350   CAGCTGTGGA      ATTAGCATAA      TGAGTGTAGT
99-1 7001-13294   CAGCTGCGGA      ATTAGTATAA      TGAGTGTTGT

.........4150   .........4160   .........4170
00-1 7001-13350   AGAACAATTA      ACTGGTAGGA      GTCCAAAACA
99-1 7001-13294   AGAACAGTTA      ACTGGTAGAA      GCCCAAAACA

.........4180   .........4190   .........4200
00-1 7001-13350   GTTAGTTTTA      ATACCTCAAT      TAGAAGAAAT
99-1 7001-13294   ATTAGTCCTA      ATCCCTCAAT      TAGAAGAGAT

.........4210   .........4220   .........4230
00-1 7001-13350   AGACATTATG      CCACCACCAG      TGTTTCAAGG
99-1 7001-13294   AGATATTATG      CCTCCTCCTG      TATTTCAAGG

.........4240   .........4250   .........4260
00-1 7001-13350   GAAATTCAAT      TATAAGCTAG      TAGATAAGAT
99-1 7001-13294   AAAATTCAAT      TATAAACTAG      TTGATAAGAT

.........4270   .........4280   .........4290
00-1 7001-13350   AACTTCTGAT      CAACATATCT      TCAGTCCAGA
99-1 7001-13294   AACCTCCGAT      CAACACATCT      TCAGTCCTGA

.........4300   .........4310   .........4320
00-1 7001-13350   CAAAATAGAT      ATGTTAACAC      TGGGAAAAAT
99-1 7001-13294   CAAAATAGAC      ATATTAACAC      TAGGGAAGAT
```

```
                        .........5050       .........5060       .........5070
00-1 7001-13350    TTTCCCTAAG          ATAACATTTG          AAAGGCTAAA
99-1 7001-13294    TTTTCCTAGG          ATAATATTTG          AGAGGTTAAA

.........5080       .........5090       .........5100
00-1 7001-13350    AAATTATGAC          ACTAGTTCAA          ATTATGCTAA
99-1 7001-13294    AAGTTATGAT          ACCAGTTCAG          ACTACAACAA

.........5110       .........5120       .........5130
00-1 7001-13350    AGGAAAGCTA          ACAAGGAATT          ACATGATACT
99-1 7001-13294    AGGGAAGTTA          ACAAGGAATT          ACATGACATT

.........5140       .........5150       .........5160
00-1 7001-13350    GTTGCCATGG          CAACATGTTA          ATAGATATAA
99-1 7001-13294    ATTACCATGG          CAACACGTAA          ACAGGTACAA

.........5170       .........5180       .........5190
00-1 7001-13350    CTTTGTCTTT          AGTTCTACTG          GATGTAAAGT
99-1 7001-13294    TTTTGTCTTT          AGTTCTACAG          GTTGTAAAGT

.........5200       .........5210       .........5220
00-1 7001-13350    TAGTCTAAAA          ACATGCATTG          GAAAACTTAT
99-1 7001-13294    CAGTTTGAAG          ACATGCATCG          GGAAATTGAT

.........5230       .........5240       .........5250
00-1 7001-13350    GAAAGATCTA          AACCCTAAAG          TTCTGTACTT
99-1 7001-13294    AAAGGATTTA          AATCCTAAAG          TTCTTTACTT

.........5260       .........5270       .........5280
00-1 7001-13350    TATTGGAGAA          GGGGCAGGAA          ATTGGATGGC
99-1 7001-13294    TATTGGAGAA          GGAGCAGGTA          ACTGGATGGC

.........5290       .........5300       .........5310
00-1 7001-13350    CAGAACAGCA          TGTGAATATC          CTGACATCAA
99-1 7001-13294    AAGAACAGCA          TGTGAATATC          CTGATATAAA

.........5320       .........5330       .........5340
00-1 7001-13350    ATTTGTATAC          AGAAGTTTAA          AAGATGACCT
99-1 7001-13294    ATTTGTATAT          AGGAGTTTAA          AGGATGACCT

.........5350       .........5360       .........5370
00-1 7001-13350    TGATCATCAT          TATCCTTTGG          AATACCAGAG
99-1 7001-13294    TGATCACCAT          TACCCATTAG          AATATCAAAG

.........5380       .........5390       .........5400
00-1 7001-13350    AGTTATAGGA          GAATTAAGCA          GGATAATAGA
99-1 7001-13294    GGTAATAGGT          GATCTAAATA          GGGTGATAGA
```

FIG.53AO

```
                        . . . . . . . . . . 5410    . . . . . . . . . . 5420    . . . . . . . . . . 5430
00-1 7001-13350         TAGCGGTGAA           GGGCTTTCAA           TGGAAACAAC
99-1 7001-13294         TAGTGGTGAA           GGATTATCAA           TGGAAACCAC

. . . . . . . . . . 5440    . . . . . . . . . . 5450    . . . . . . . . . . 5460
00-1 7001-13350         AGATGCAACT           CAAAAAACTC           ATTGGGATTT
99-1 7001-13294         AGATGCAACT           CAAAAAACTC           ATTGGGACTT

. . . . . . . . . . 5470    . . . . . . . . . . 5480    . . . . . . . . . . 5490
00-1 7001-13350         GATACACAGA           GTAAGCAAAG           ATGCTTTATT
99-1 7001-13294         GATACACAGA           ATAAGTAAAG           ATGCTTTATT

. . . . . . . . . . 5500    . . . . . . . . . . 5510    . . . . . . . . . . 5520
00-1 7001-13350         AATAACTTTA           TGTGATGCAG           AATTTAAGGA
99-1 7001-13294         GATCCACTTG           TGTGATGCAG           AATTCAAAAA

. . . . . . . . . . 5530    . . . . . . . . . . 5540    . . . . . . . . . . 5550
00-1 7001-13350         CAGAGATGAT           TTTTTTAAGA           TGGTAATTCT
99-1 7001-13294         CAGAGATGAT           TTCTTTAAGA           TGGTAATCCT

. . . . . . . . . . 5560    . . . . . . . . . . 5570    . . . . . . . . . . 5580
00-1 7001-13350         ATGGAGGAAA           CATGTATTAT           CATGCAGAAT
99-1 7001-13294         TTGGAGAAAA           CATGTATTAT           CTTGTAGAAT

. . . . . . . . . . 5590    . . . . . . . . . . 5600    . . . . . . . . . . 5610
00-1 7001-13350         TTGCACTACT           TATGGGACAG           ACCTCTATTT
99-1 7001-13294         CTGTACAGCT           TATGGAACAG           ATCTTTACTT

. . . . . . . . . . 5620    . . . . . . . . . . 5630    . . . . . . . . . . 5640
00-1 7001-13350         ATTCGCAAAG           TATCATGCTA           AAGACTGCAA
99-1 7001-13294         ATTTGCAAAG           TATCATGCGG           TGGACTGCAA

. . . . . . . . . . 5650    . . . . . . . . . . 5660    . . . . . . . . . . 5670
00-1 7001-13350         TGTAAAATTA           CCTTTTTTTG           TGAGATCAGT
99-1 7001-13294         TATAAAATTA           CCATTTTTTG           TAAGATCTGT

. . . . . . . . . . 5680    . . . . . . . . . . 5690    . . . . . . . . . . 5700
00-1 7001-13350         AGCCACCTTT           ATTATGCAAG           GTAGTAAACT
99-1 7001-13294         AGCTACTTTT           ATTATGCAAG           GAAGCAAATT

. . . . . . . . . . 5710    . . . . . . . . . . 5720    . . . . . . . . . . 5730
00-1 7001-13350         GTCAGGCTCA           GAATGCTACA           TACTCTTAAC
99-1 7001-13294         ATCAGGGTCA           GAATGTTACA           TACTTTTAAC

. . . . . . . . . . 5740    . . . . . . . . . . 5750    . . . . . . . . . . 5760
00-1 7001-13350         ACTAGGCCAC           CACAACAATT           TACCCTGCCA
99-1 7001-13294         ATTAGGTCAT           CACAATAATC           TACCCTGTCA
```

5' cDNA Terminal Sequences of hMPV

METAPNEUMOVIRUS STRAINS AND THEIR USE IN VACCINE FORMULATIONS AND AS VECTORS FOR EXPRESSION OF ANTIGENIC SEQUENCES

This application claims priority to U.S. Provisional Patent Application No. 60/358,934, filed Feb. 21, 2002, which is incorporated by reference herein in its entirety.

Copending and co-assigned U.S. patent application Ser. No. 10/373,567, filed on even date herewith, listing Ronaldus Fouchier, Bernadetta van den Hoogen, Albertus Osterhaus, Aurelia Haller, and Roderick Tang as Inventors, entitled "Recombinant Parainfluenza Virus Expression Systems and Vaccines Comprising Heterologous Antigens Derived from Metapneumovirus", is incorporated herein by reference in its entirety.

1. INTRODUCTION

The invention relates to an isolated mammalian negative strand RNA virus, *metapneumovirus* (MPV), within the subfamily Pneumoviridae, of the family Paramyxoviridae. The present invention also relates to isolated mammalian negative strand RNA viruses identifiable as phylogenetically corresponding or relating to the genus *Metapneumovirus* and components thereof. The invention relates to genomic nucleotide sequences of different isolates of mammalian *metapneumoviruses*, in particular human *metapneumoviruses*. The invention relates to the use of the sequence information of different isolates of mammalian *metapneumoviruses* for diagnostic and therapeutic methods. The present invention relates to nucleotide sequences encoding the genome of a *metapneumovirus* or a portion thereof, including both mammalian and avian *metapneumovirus*. The invention further encompasses chimeric or recombinant viruses encoded by said nucleotide sequences. The invention also relates to chimeric and recombinant mammalian MPV that comprise one or more non-native or heterologous sequences. The invention further relates to vaccine formulations comprising mammalian or avian *metapneumovirus*, including recombinant and chimeric forms of said viruses. The vaccine preparations of the invention encompass multivalent vaccines, including bivalent and trivalent vaccine preparations.

2. BACKGROUND OF THE INVENTION

Classically, as devastating agents of disease, paramyxoviruses account for many animal and human deaths worldwide each year. The Paramyxoviridae form a family within the order of Mononegavirales (negative-sense single stranded RNA viruses), consisting of the sub-families Paramyxovirinae and Pneumovirinae. The latter sub-family is at present taxonomically divided in the genera Pneumovirus and *Metapneumovirus* (Pringle, 1999, Arch. Virol. 144/2, 2065-2070). Human respiratory syncytial virus (hRSV), a species of the Pneumovirus genus, is the single most important cause of lower respiratory tract infections during infancy and early childhood worldwide (Domachowske, & Rosenberg, 1999, Clin. Microbio. Rev. 12(2): 298-309). Other members of the Pneumovirus genus include the bovine and ovine respiratory syncytial viruses and pneumonia virus of mice (PVM).

In the past decades several etiological agents of mammalian disease, in particular of respiratory tract illnesses (RTI), in particular of humans, have been identified (Evans, In: Viral Infections of Humans, Epidemiology and Control. 3th edn. (ed. Evans, A. S) 22-28 (Plenum Publishing Corporation, New York, 1989)). Classical etiological agents of RTI with mammals are respiratory syncytial viruses belonging to the genus Pneumovirus found with humans (hRSV) and ruminants such as cattle or sheep (bRSV and/or oRSV). In human RSV differences in reciprocal cross neutralization assays, reactivity of the G proteins in immunological assays, and nucleotide sequences of the G gene are used to define two hRSV antigenic subgroups. Within the subgroups the amino acid sequences show 94% (subgroup A) or 98% (subgroup B) identity, while only 53% amino acid sequence identity is found between the subgroups. Additional variability is observed within subgroups based on monoclonal antibodies, RT-PCR assays and RNAse protection assays. Viruses from both subgroups have a worldwide distribution and may occur during a single season. Infection may occur in the presence of pre-existing immunity and the antigenic variation is not strictly required to allow re-infection. See, for example Sullender, 2000, Clinical Microbiology Reviews 13(1): 1-15; Collins et al. Fields Virology, ed. B. N. Knipe, Howley, P. M. 1996, Philadelphia: Lippencott-Raven. 1313-1351; Johnson et al., 1987, (Proc Natl Acad Sci USA, 84(16): 5625-9; Collins, in The Paramyxoviruses, D. W. Kingsbury, Editor. 1991, Plenum Press: New York. p. 103-153.

Another classical Pneumovirus is the pneumonia virus of mice (PVM), in general only found with laboratory mice. However, a proportion of the illnesses observed among mammals can still not be attributed to known pathogens.

2.1 Avian *Metapneumovirus*

Respiratory disease caused by an avian pneumovirus (APV) was first described in South Africa in the late 1970s (Buys et al., 1980, Turkey 28:36-46) where it had a devastating effect on the turkey industry. The disease in turkeys was characterized by sinusitis and rhinitis and was called turkey rhinotracheitis (TRT). The European isolates of APV have also been strongly implicated as factors in swollen head syndrome (SHS) in chickens (O'Brien, 1985, Vet. Rec. 117:619-620). Originally, the disease appeared in broiler chicken flocks infected with Newcastle disease virus (NDV) and was assumed to be a secondary problem associated with Newcastle disease (ND). Antibody against European APV was detected in affected chickens after the onset of SHS (Cook et al., 1988, Avian Pathol. 17:403-410), thus implicating APV as the cause.

Avian pneumovirus (APV) also known as turkey rhinotracheitis virus (TRTV), the aetiological agent of avian rhinotracheitis, an upper respiratory tract infection of turkeys (Giraud et al., 1986, Vet. Res. 119:606-607), is the sole member of the recently assigned *Metapneumovirus* genus, which, as said was until now not associated with infections, or what is more, with disease of mammals. Serological subgroups of APV can be differentiated on the basis of nucleotide or amino acid sequences of the G glycoprotein and neutralization tests using monoclonal antibodies that also recognize the G glycoprotein. However, other differences in the nucleotide and amino acid sequences can be used to distinguish serological subgroups of APV. Within subgroups A, B and D, the G protein shows 98.5 to 99.7% aa sequence identity within subgroups while between the subgroups only 31.2-38% aa identity is observed. See for example Collins et al., 1993, Avian Pathology, 22: p. 469-479; Cook et al., 1993, Avian Pathology, 22: 257-273; Bayon-Auboyer et al., J Gen Virol, 81(Pt 11): 2723-33; Seal, 1998, Virus Res, 58(1-2): 45-52; Bayon-Auboyer et al., 1999, Arch Virol, 144(6): 91-109; Juhasz, et al., 1994, J Gen Virol, 75(Pt 11): 2873-80.

A further serotype of APV is provided in WO00/20600, incorporated by reference herein, which describes the Colorado isolate of APV and compared it to known APV or TRT strains with in vitro serum neutralization tests. First, the Colorado isolate was tested against monospecific polyclonal antisera to recognized TRT isolates. The Colorado isolate was not neutralized by monospecific antisera to any of the TRT strains. It was, however, neutralized by a hyperimmune antiserum raised against a subgroup A strain. This antiserum neutralized the homologous virus to a titre of 1:400 and the Colorado isolate to a titer of 1: 80. Using the above method, the Colorado isolate was then tested against TRT monoclonal antibodies. In each case, the reciprocal neutralization titer was <10. Monospecific antiserum raised to the Colorado isolate was also tested against TRT strains of both subgroups. None of the TRT strains tested were neutralized by the antiserum to the Colorado isolate.

The Colorado strain of APV does not protect SPF chicks against challenge with either a subgroup A or a subgroup B strain of TRT virus. These results suggest that the Colorado isolate may be the first example of a further serotype of avian pneumovirus (See, Bayon-Auboyer et al., 2000, J. Gen. Vir. 81:2723-2733).

The avian pneumovirus is a single stranded, non-segmented RNA virus that belongs to the sub-family Pneumovirinae of the family Paramyxoviridae, genus *metapneumovirus* (Cavanagh and Barrett, 1988, Virus Res. 11:241-256; Ling et al., 1992, J. Gen. Virol. 73:1709-1715; Yu et al., 1992, J. Gen. Virol. 73:1355-1363). The Paramyxoviridae family is divided into two sub-families: the Paramyxovirinae and Pneumovirinae. The subfamily Paramyxovirinae includes, but is not limited to, the genera: Paramyxovirus, Rubulavirus, and Morbillivirus. Recently, the sub-family Pneumovirinae was divided into two genera based on gene order, and sequence homology, i.e. pneumovirus and metapneumovirus (Naylor et al., 1998, J. Gen. Virol., 79:1393-1398; Pringle, 1998, Arch. Virol. 143:1449-1159). The pneumovirus genus includes, but is not limited to, human respiratory syncytial virus (hRSV), bovine respiratory syncytial virus (bRSV), ovine respiratory syncytial virus, and mouse pneumovirus. The metapneumovirus genus includes, but is not limited to, European avian pneumovirus (subgroups A and B), which is distinguished from hRSV, the type species for the genus pneumovirus (Naylor et al., 1998, J. Gen. Virol., 79:1393-1398; Pringle, 1998, Arch. Virol. 143:1449-1159). The US isolate of APV represents a third subgroup (subgroup C) within *metapneumovirus* genus because it has been found to be antigenically and genetically different from European isolates (Seal, 1998, Virus Res. 58:45-52; Senne et al., 1998, In: Proc. 47th WPDC, California, pp. 67-68).

Electron microscopic examination of negatively stained APV reveals pleomorphic, sometimes spherical, virions ranging from 80 to 200 nm in diameter with long filaments ranging from 1000 to 2000 nm in length (Collins and Gough, 1988, J. Gen. Virol. 69:909-916). The envelope is made of a membrane studded with spikes 13 to 15 nm in length. The nucleocapsid is helical, 14 nm in diameter and has 7 nm pitch. The nucleocapsid diameter is smaller than that of the genera Paramyxovirus and Morbillivirus, which usually have diameters of about 18 nm.

Avian pneumovirus infection is an emerging disease in the USA despite its presence elsewhere in the world in poultry for many years. In May 1996, a highly contagious respiratory disease of turkeys appeared in Colorado, and an APV was subsequently isolated at the National Veterinary Services Laboratory (NVSL) in Ames, Iowa (Senne et al., 1997, Proc. 134th Ann. Mtg., AVMA, pp. 190). Prior to this time, the United States and Canada were considered free of avian pneumovirus (Pearson et al., 1993, In: Newly Emerging and Re-emerging Avian Diseases: Applied Research and Practical Applications for Diagnosis and Control, pp. 78-83; Hecker and Myers, 1993, Vet. Rec. 132:172). Early in 1997, the presence of APV was detected serologically in turkeys in Minnesota. By the time the first confirmed diagnosis was made, APV infections had already spread to many farms. The disease is associated with clinical signs in the upper respiratory tract: foamy eyes, nasal discharge and swelling of the sinuses. It is exacerbated by secondary infections. Morbidity in infected birds can be as high as 100%. The mortality can range from 1 to 90% and is highest in six to twelve week old poults.

Avian pneumovirus is transmitted by contact. Nasal discharge, movement of affected birds, contaminated water, contaminated equipment; contaminated feed trucks and load-out activities can contribute to the transmission of the virus. Recovered turkeys are thought to be carriers. Because the virus is shown to infect the epithelium of the oviduct of laying turkeys and because APV has been detected in young poults, egg transmission is considered a possibility.

2.2 PIV Infections

Parainfluenza viral infection results in serious respiratory tract disease in infants and children. (Tao et al., 1999, Vaccine 17: 1100-08). Infectious parainfluenza viral infections account for approximately 20% of all hospitalizations of pediatric patients suffering from respiratory tract infections worldwide. Id.

PIV is a member of the genus respirovirus (PIV1, PIV3) or rubulavirus (PIV2, PIV4) of the paramyxoviridae family. PIV is made up of two structural modules: (1) an internal ribonucleoprotein core, or nucleocapsid, containing the viral genome, and (2) an outer, roughly spherical lipoprotein envelope. Its genome is a single strand of negative sense RNA, approximately 15,456 nucleotides in length, encoding at least eight polypeptides. These proteins include, but are not limited to, the nucleocapsid structural protein (NP, NC, or N depending on the genera), the phosphoprotein (P), the matrix protein (M), the fusion glycoprotein (F), the hemagglutinin-neuraminidase glycoprotein (HN), the large polymerase protein (L), and the C and D proteins of unknown function. Id.

The parainfluenza nucleocapsid protein (NP, NC, or N) consists of two domains within each protein unit including an amino-terminal domain, comprising about two-thirds of the molecule, which interacts directly with the RNA, and a carboxyl-terminal domain, which lies on the surface of the assembled nucleocapsid. A hinge is thought to exist at the junction of these two domains thereby imparting some flexibility to this protein (see Fields et al. (ed.), 1991, Fundamental Virology, Second Edition, Raven Press, New York, incorporated by reference herein in its entirety). The matrix protein (M), is apparently involved with viral assembly and interacts with both the viral membrane as well as the nucleocapsid proteins. The phosphoprotein (P), which is subject to phosphorylation, is thought to play a regulatory role in transcription, and may also be involved in methylation, phosphorylation and polyadenylation. The fusion glycoprotein (F) interacts with the viral membrane and is first produced as an inactive precursor, then cleaved post-translationally to produce two disulfide linked polypeptides. The active F protein is also involved in penetration of the parainfluenza virion into host cells by facilitating fusion of the viral envelope with the host cell plasma membrane. Id. The glycoprotein, hemagglutinin-neuraminidase (HN), protrudes from the envelope allowing the virus to contain both hemagglutinin and neuraminidase activities. HN is strongly hydrophobic at its amino terminal which functions to anchor the HN protein into the lipid bilayer. Id. Finally, the large polymerase protein (L) plays an important role in both transcription and replication. Id.

2.3 RSV Infections

Respiratory syncytial virus (RSV) is the leading cause of serious lower respiratory tract disease in infants and children (Feigen et al., eds., 1987, In: Textbook of Pediatric Infectious Diseases, W B Saunders, Philadelphia at pages 1653-1675; New Vaccine Development, Establishing Priorities, Vol. 1, 1985, National Academy Press, Washington D.C. at pages 397-409; and Ruuskanen et al., 1993, Curr. Probl. Pediatr. 23:50-79). The yearly epidemic nature of RSV infection is evident worldwide, but the incidence and severity of RSV disease in a given season vary by region (Hall, 1993, Contemp. Pediatr. 10:92-110). In temperate regions of the northern hemisphere, it usually begins in late fall and ends in late spring. Primary RSV infection occurs most often in children from 6 weeks to 2 years of age and uncommonly in the first 4 weeks of life during nosocomial epidemics (Hall et al., 1979, New Engl. J. Med. 300:393-396). Children at increased risk for RSV infection include, but are not limited to, preterm infants (Hall et al., 1979, New Engl. J. Med. 300:393-396) and children with bronchopulmonary dysplasia (Groothuis et al., 1988, Pediatrics 82:199-203), congenital heart disease (MacDonald et al., New Engi. J. Med. 307:397-400), congenital or acquired immunodeficiency (Ogra et al., 1988, Pediatr. Infect. Dis. J. 7:246-249; and Pohl et al., 1992, J. Infect. Dis. 165:166-169), and cystic fibrosis (Abman et al., 1988, J. Pediatr. 113:826-830). The fatality rate in infants with heart or lung disease who are hospitalized with RSV infection is 3%-4% (Navas et al., 1992, J. Pediatr. 121:348-354).

RSV infects adults as well as infants and children. In healthy adults, RSV causes predominantly upper respiratory tract disease. It has recently become evident that some adults, especially the elderly, have symptomatic RSV infections more frequently than had been previously reported (Evans, A. S., eds., 1989, Viral Infections of Humans. Epidemiology and Control, 3rd ed., Plenum Medical Book, New York at pages 525-544). Several epidemics also have been reported among nursing home patients and institutionalized young adults (Falsey, A. R., 1991, Infect. Control Hosp. Epidemiol. 12:602-608; and Garvie et al., 1980, Br. Med. J. 281:1253-1254). Finally, RSV may cause serious disease in immunosuppressed persons, particularly bone marrow transplant patients (Hertz et al., 1989, Medicine 68:269-281).

Treatment options for established RSV disease are limited. Severe RSV disease of the lower respiratory tract often requires considerable supportive care, including administration of humidified oxygen and respiratory assistance (Fields et al., eds, 1990, Fields Virology, 2nd ed., Vol. 1, Raven Press, New York at pages 1045-1072).

While a vaccine might prevent RSV infection, and/or RSV-related disease, no vaccine is yet licensed for this indication. A major obstacle to vaccine development is safety. A formalin-inactivated vaccine, though immunogenic, unexpectedly caused a higher and more severe incidence of lower respiratory tract disease due to RSV in immunized infants than in infants immunized with a similarly prepared trivalent parainfluenza vaccine (Kim et al., 1969, Am. J. Epidemiol. 89:422-434; and Kapikian et al., 1969, Am. J. Epidemiol. 89:405-421). Several candidate RSV vaccines have been abandoned and others are under development (Murphy et al., 1994, Virus Res. 32:13-36), but even if safety issues are resolved, vaccine efficacy must also be improved. A number of problems remain to be solved. Immunization would be required in the immediate neonatal period since the peak incidence of lower respiratory tract disease occurs at 2-5 months of age. The immaturity of the neonatal immune response together with high titers of maternally acquired RSV antibody may be expected to reduce vaccine immunogenicity in the neonatal period (Murphy et al., 1988, J. Virol. 62:3907-3910; and Murphy et al., 1991, Vaccine 9:185-189). Finally, primary RSV infection and disease do not protect well against subsequent RSV disease (Henderson et al., 1979, New Engl. J. Med. 300:530-534).

Currently, the only approved approach to prophylaxis of RSV disease is passive immunization. Initial evidence suggesting a protective role for IgG was obtained from observations involving maternal antibody in ferrets (Prince, G. A., Ph.D. diss., University of California, Los Angeles, 1975) and humans (Lambrecht et al, 1976, J. Infect. Dis. 134:211-217; and Glezen et al., 1981, J. Pediatr. 98:708-715). Hemming et al. (Morell et al., eds., 1986, Clinical Use of Intravenous Immunoglobulins, Academic Press, London at pages 285-294) recognized the possible utility of RSV antibody in treatment or prevention of RSV infection during studies involving the pharmacokinetics of an intravenous immune globulin (IVIG) in newborns suspected of having neonatal sepsis. In this study, it was noted that one infant, whose respiratory secretions yielded RSV, recovered rapidly after IVIG infusion. Subsequent analysis of the IVIG lot revealed an unusually high titer of RSV neutralizing antibody. This same group of investigators then examined the ability of hyperimmune serum or immune globulin, enriched for RSV neutralizing antibody, to protect cotton rats and primates against RSV infection (Prince et al., 1985, Virus Res. 3:193-206; Prince et al., 1990, J. Virol. 64:3091-3092; Hemming et al., 1985, J. Infect. Dis. 152:1083-1087; Prince et al., 1983, Infect. Immun. 42:81-87; and Prince et al., 1985, J. Virol. 55:517-520). Results of these studies indicate that IVIG may be used to prevent RSV infection, in addition to treating or preventing RSV-related disorders.

Recent clinical studies have demonstrated the ability of this passively administered RSV hyperimmune globulin (RSV IVIG) to protect at-risk children from severe lower respiratory infection by RSV (Groothius et al., 1993, New Engl. J. Med. 329:1524-1530; and The PREVENT Study Group, 1997, Pediatrics 99:93-99). While this is a major advance in preventing RSV infection, this treatment poses certain limitations in its widespread use. First, RSV IVIG must be infused intravenously over several hours to achieve an effective dose. Second, the concentrations of active material in hyperimmune globulins are insufficient to treat adults at risk or most children with comprised cardiopulmonary function. Third, intravenous infusion necessitates monthly hospital visits during the RSV season. Finally, it may prove difficult to select sufficient donors to produce a hyperimmune globulin for RSV to meet the demand for this product. Currently, only approximately 8% of normal donors have RSV neutralizing antibody titers high enough to qualify for the production of hyperimmune globulin.

One way to improve the specific activity of the immunoglobulin would be to develop one or more highly potent RSV neutralizing monoclonal antibodies (MAbs). Such MAbs should be human or humanized in order to retain favorable pharmacokinetics and to avoid generating a human anti-mouse antibody response, as repeat dosing would be required throughout the RSV season. Two glycoproteins, F and G, on the surface of RSV have been shown to be targets of neutralizing antibodies (Fields et al., 1990, supra; and Murphy et al., 1994, supra).

A humanized antibody directed to an epitope in the A antigenic site of the F protein of RSV, SYNAGIS®, is approved for intramuscular administration to pediatric patients for prevention of serious lower respiratory tract disease caused by RSV at recommended monthly doses of 15 mg/kg of body weight throughout the RSV season (November through April in the northern hemisphere). SYNAGIS® is a composite of human (95%) and murine (5%) antibody sequences. See, Johnson et al., 1997, J. Infect. Diseases 176: 1215-1224 and U.S. Pat. No. 5,824,307, the entire contents of which are incorporated herein by reference. The human heavy chain sequence was derived from the constant domains of human IgG1 and the variable framework regions of the VH genes of Cor (Press et al., 1970, Biochem. J. 117:641-660) and Cess (Takashi et al., 1984, Proc. Natl Acad. Sci. USA 81:194-198). The human light chain sequence was derived from the constant domain of $C_K$ and the variable framework regions of the VL gene K104 with $J_K$-4 (Bentley et al., 1980, Nature 288:5194-5198). The murine sequences derived from a murine monoclonal antibody, Mab 1129 (Beeler et al., 1989, J. Virology 63:2941-2950), in a process which involved the grafting of the murine complementarity determining regions into the human antibody frameworks.

A significant portion of human respiratory disease is caused by members of the viral sub-families Paramyxovirinae and Pneumovirinae. The identification of another mammalian Pneumovirinae that infects humans, hMPV, is described for the first time herein. There still remains a need for an effective vaccine to confer protection against a variety of viruses that result in respiratory tract infection.

Citation or discussion of a reference herein shall not be construed as an admission that such is prior art to the present invention.

3. SUMMARY OF THE INVENTION

The invention relates to an isolated mammalian negative strand RNA virus, *metapneumovirus* (MPV), within the subfamily Pneumovirinae, of the family Paramyxoviridae. The present invention also relates to isolated mammalian negative strand RNA viruses identifiable as phylogenitically corresponding or relating to the genus *Metapneumovirus* and components thereof. In particular, the invention relates to a mammalian MPV that is phylogenetically more closely related to a virus isolate deposited as I-2614 with CNCM, Paris than it is related to APV type C. In more specific embodiments, the mammalian MPV can be a variant A1, A2, B1 or B2 mammalian MPV. However, the mammalian MPVs of the present invention may encompass additional variants yet to be identified, and are not limited to variants A1, A2, B1 or B2.

The invention relates to genomic nucleotide sequences of different isolates of mammalian *metapneumoviruses*, in particular human *metapneumoviruses*. The invention relates to the use of the sequence information of different isolates of mammalian *metapneumoviruses* for diagnostic and therapeutic methods. The present invention relates to the differences of the genomic nucleotide sequences among the different *metapneumovirus*-isolates, and their use in the diagnostic and therapeutic methods of the invention. In specific embodiments, the nucleotide sequence of a mammalian MPV that encodes for the N, M, F, L, P, M2-1, M2-2, SH or G ORFs may be used to identify a virus of the invention. In other specific embodiments, the nucleotide sequence of mammalian MPV that encodes for the N, M, F, L, P, M2-1, M2-2, SH or G ORFs used to classify a mammalian MPV into variant A1, A2, B1 or B2. In a specific embodiment; the invention relates to the use of the single nucleotide polymorphisms (SNPs) among different metapneumovirus isolates for diagnostic purposes.

The invention relates to recombinant and chimeric viruses that are derived from a mammalian MPV or avian pneumovirus (APV). In accordance with the present invention, a recombinant virus is one derived from a mammalian MPV or an APV that is encoded by endogenous or native genomic sequences or non-native genomic sequences. In accordance with the invention, a non-native sequence is one that is different from the native or endogenous genomic sequence due to one or more mutations, including, but not limited to, point mutations, rearrangements, insertions, deletions etc., to the genomic sequence that may or may not result in a phenotypic change. In accordance with the invention, a chimeric virus of the invention is a recombinant MPV or APV which further comprises a heterologous nucleotide sequence. In accordance with the invention, a chimeric virus may be encoded by a nucleotide sequence in which heterologous nucleotide sequences have been added to the genome or in which endogenous or native nucleotide sequences have been replaced with heterologous nucleotide sequences. In certain embodiments, a chimeric virus of the invention is derived from a MPV or APV in which one or more of the ORFs or a portion thereof is replaced by a homologous ORF or a portion thereof from another strain of *metapneumovirus*. In an exemplary embodiment, the ORF of the F gene of a mammalian MPV is replaced by the ORF of the F gene of an APV. In certain other embodiments, a chimeric virus of the invention is derived from an APV in which one or more of the ORFs is replaced by a homologous ORF of a mammalian MPV.

The present invention relates to nucleotide sequences encoding the genome of a *metapneumovirus* (including mammalian and avian strains) or a portion thereof. The present invention relates to nucleotide sequences encoding gene products of a *metapneumovirus*. In particular, the invention relates to, but is not limited to, nucleotide sequences encoding an F protein, a G protein, an M protein, an SH protein, an N protein, a P protein, an M2 protein, or an L protein of a MPV. In particular the invention relates to nucleotide sequences encoding an F protein, a G protein, an M protein, an SH protein, an N protein, a P protein, an M2 protein, or an L protein of a variant of mammalian MPV, such as but not limited to variant A1, A2, B1 or B2 of a MPV. The present invention further relates to a cDNA or RNA that encodes the genome or a portion thereof of a *metapneumovirus*, including both mammalian and avian, in addition to a nucleotide sequence which is heterologous or non-native to the viral genome. The invention further encompasses chimeric or recombinant viruses encoded by said cDNAs or RNAs.

The invention further relates to polypeptides and amino acid sequences of an F protein, a G protein, an M protein, an SH protein, an N protein, a P protein, an M2 protein, or an L protein of a mammalian MPV and different variants of mammalian MPV. The invention further relates to antibodies against an F protein, a G protein, an M protein, an SH protein, an N protein, a P protein, an M2 protein, or an L protein of a mammalian MPV and different variants of mammalian MPV. The antibodies can be used for diagnostic and therapeutic methods. In certain more specific embodiments, the antibodies are specific to mammalian MPV. In certain embodiments, the antibodies are specific to a variant of mammalian MPV. The invention further relates to vaccine formulations and immunogenic compositions comprising one or more of the following: an F protein, a G protein, an M protein, an SH protein, an N protein, a P protein, an M2 protein, and/or an L protein of a mammalian MPV.

The invention further relates to vaccine formulations and immunogenic compositions comprising mammalian or avian *metapneumovirus*, including recombinant and chimeric forms of said viruses. In particular, the present invention encompasses vaccine preparations comprising recombinant or chimeric forms of MPV and/or APV. The invention further relates to vaccines comprising chimeric MPV wherein the chimeric MPV encodes one or more APV proteins and wherein the chimeric MPV optionally additionally expresses one or more heterologous or non-native sequences. The invention also relates to vaccines comprising chimeric APV wherein the chimeric APV encodes one or more hMPV proteins and wherein the chimeric APV optionally additionally expresses one or more heterologous or non-native sequences. The present invention also relates to multivalent vaccines, including bivalent and trivalent vaccines. In particular, multivalent vaccines of the invention encompass two or more antigenic polypeptides expressed by the same or different pneumoviral vectors. The antigenic polypeptides of the multivalent vaccines include but are not limited to, antigenic polypeptides of MPV, APV, PIV, RSV, influenza or another negative strand RNA virus, or another virus, such as morbillivirus.

The invention further relates to methods for treating a respiratory tract infection in a subject. In certain embodiments, the invention relates to treating a respiratory tract infection in a subject by administering to the subject a vaccine formulation comprising a mammalian MPV. In specific embodiments, the methods for treating a respiratory tract infection in a subject comprise administering to the subject a vaccine formulation or an immunogenic composition comprising a recombinant or a chimeric mammalian MPV or APV. In more specific embodiments, the recombinant or chimeric mammalian MPV is attenuated. In a specific embodiment, the invention relates to treating a respiratory tract infection in a human patient comprising administering to the human patient a vaccine formulation comprising a recombinant or chimeric APV, or a nucleotide sequence encoding an F protein, a G protein, an M protein, an SH protein, an N protein, a P protein, an M2 protein, or an L protein of APV.

The invention provides an isolated negative-sense single stranded RNA virus MPV belonging to the sub-family Pneumovirinae of the family Paramyxoviridae and identifiable as phylogenetically corresponding to the genus *Metapneumovirus*, wherein the virus is phylogenetically more closely related to a virus isolate comprising the nucleotide sequence of SEQ ID NO:18, SEQ ID NO:19, SEQ ID NO:20, or SEQ ID NO:21 than it is related to turkey rhinotracheitis virus, the etiological agent of avian rhinotracheitis. In certain embodiments, the invention provides an isolated negative-sense single stranded RNA *metapneumovirus*, wherein the genome of the virus comprises a nucleotide sequence of SEQ ID NO:18. In certain embodiments, the invention providesa n isolated negative-sense single stranded RNA metapneumovirus, wherein the genome of the virus comprises a nucleotide sequence of SEQ ID NO:19. In certain embodiments, the invention provides an isolated negative-sense single stranded RNA *metapneumovirus*, wherein the genome of the virus comprises a nucleotide sequence of SEQ ID NO:20. In certain embodiments, the invention provides an isolated negative-sense single stranded RNA *metapneumovirus*, wherein the genome of the virus comprises a nucleotide sequence of SEQ ID NO:21. In certain embodiments, the invention provides an isolated nucleic acid, wherein the nucleic acid has a nucleotide sequence that is at least 70% identical to SEQ ID NO:18, SEQ ID NO:19, SEQ ID NO:20 or SEQ ID NO:21, wherein sequence identity is determined over the entire length of SEQ ID NO:19, SEQ ID NO:20, SEQ ID NO:21 or SEQ ID NO:22. In certain embodiments, the invention providesa n isolated nucleic acid, wherein the nucleic acid encodes a protein comprising (i) an amino acid sequence that is at least 66% identical to the G protein of a mammalian MPV variant B1 (SEQ ID NO:324); (ii) an amino acid sequence that is at least 98.5% identical to the N protein of a mammalian MPV variant B1 (SEQ ID NO:368); (iii) an amino acid sequence that is at least 96% identical the P protein of a mammalian MPV variant B1 (SEQ ID NO:376); (iv) an amino acid sequence that is identical the M protein of a mammalian MPV variant B1 (SEQ ID NO:360); (v) an amino acid sequence that is at least 99% identical the F protein of a mammalian MPV variant B1 (SEQ ID NO:316); (vi) an amino acid sequence that is at least 98% identical the M2-1 protein of a mammalian MPV variant B1 (SEQ ID NO:340); (vii) an amino acid sequence that is at least 99% identical the M2-2 protein of a mammalian MPV variant B1 (SEQ ID NO:348); (viii) an amino acid sequence that is at least 83% identical the SH protein of a mammalian MPV variant B1 (SEQ ID NO:384); or (ix) an amino acid sequence that is at least 99% identical the L protein a mammalian MPV variant B1 (SEQ ID NO:332). In certain embodiments, the invention provides an isolated nucleic acid, wherein the nucleic acid encodes a protein comprising (i) an amino acid sequence that is at least 66% identical to the G protein of a mammalian MPV variant A1 (SEQ ID NO:322); (ii) an amino acid sequence that is at least 99.5% identical to the N protein of a mammalian MPV variant A1 (SEQ ID NO:366); (iii) an amino acid sequence that is at least 96% identical to the P protein of a mammalian MPV variant A1 (SEQ ID NO:374); (iv) an amino acid sequence that is at least 99% identical to the M protein of a mammalian MPV variant A1 (SEQ ID NO:358); (v) an amino acid sequence that is at least 98% identical to the F protein of a mammalian MPV variant A1 (SEQ ID NO:314); (vi) an amino acid sequence that is at least 99% identical to the M2-1 protein of a mammalian MPV variant A1 (SEQ ID NO:338) (vii) an amino acid sequence that is at least 96% identical to the M2-2 protein of a mammalian MPV variant A1 (SEQ ID NO:346) (viii) an amino acid sequence that is at least 84% identical to the SH protein of a mammalian MPV variant A1 (SEQ ID NO:382); or (ix) an amino acid sequence that is at least 99% identical to the L protein of a virus of a mammalian MPV variant A1 (SEQ ID NO:330). In certain embodiments, the invention provides n isolated nucleic acid, wherein the nucleic acid encodes a protein comprising (i) an amino acid sequence that is at least 66% identical to the G protein of a mammalian MPV variant A2 (SEQ ID NO:332); (ii) an amino acid sequence that is at least 99.5% identical to the N protein of a mammalian MPV variant A2 (SEQ ID NO:367); (iii) an amino acid sequence that is at least 96% identical to the P protein of a mammalian MPV variant A2 (SEQ ID NO:375); (iv) an amino acid sequence that is at least 99% identical to the M protein of a mammalian MPV variant A2 (SEQ ID NO:359); (v) an amino acid sequence that is at least 98% identical to the F protein of a mammalian MPV variant A2 (SEQ ID NO:315); (vi) an amino acid sequence that is at least 99% identical to the M2-1 protein of a mammalian MPV variant A2 (SEQ ID NO: 339); (vii) an amino acid sequence that is at least 96% identical to the M2-2 protein of a mammalian MPV variant A2 (SEQ ID NO:347); (viii) an amino acid sequence that is at least 84% identical to the SH protein of a mammalian MPV variant A2 (SEQ ID NO:383); or (ix) an amino acid sequence that is at least 99% identical to the L protein of a mammalian MPV variant A2 (SEQ ID NO:331). In certain embodiments, the invention provides an isolated nucleic acid, wherein the nucleic acid encodes a protein comprising (i) an amino acid sequence that is at least 66% identical to the G protein of a mammalian MPV variant B2 (SEQ ID NO:325); (ii) an amino acid sequence that is at least 97% identical to the N protein of a mammalian MPV variant B2 (SEQ ID NO:369); (iii) an amino acid sequence that is at least 96% identical to the P protein of a mammalian MPV variant B2 (SEQ ID NO:377); (iv) an amino acid sequence that is identical to the M protein of a mammalian MPV variant B2 (SEQ ID NO:361) (v) an amino acid sequence that is at least 99% identical to the F protein of a mammalian MPV variant B2 (SEQ ID NO:317); (vi) an amino acid sequence that is at least 98% identical to the M2-1 protein of a mammalian MPV variant B2 (SEQ ID NO:341); (vii) an amino acid sequence that is at least 99% identical to the M2-2 protein of a mammalian MPV variant B2 (SEQ ID NO:349); (viii) an amino acid sequence that is at least 84% identical to the SH protein of a mammalian MPV variant B2 (SEQ ID NO:385); or (ix) an amino acid sequence that is at least 99% identical to the L protein of a mammalian MPV variant B2 (SEQ ID NO:333). In certain embodiments, the invention provides an isolated nucleic acid, wherein the nucleic acid hybridizes specifically under high stringency, medium stringency, or low stringency conditions to a nucleic acid of a mammalian MPV.

In certain embodiments, the invention provides a virus comprising the nucleotide sequence of SEQ ID NO:18-21 or a fragment thereof.

In certain embodiments, the invention provides an isolated protein, wherein the protein comprises (i) an amino acid sequence that is at least 66% identical to the G protein of a mammalian MPV variant B1 (SEQ ID NO:324); (ii) an amino acid sequence that is at least 98.5% identical to the N protein of a mammalian MPV variant B1 (SEQ ID NO:368); (iii) an amino acid sequence that is at least 96% identical the P protein of a mammalian MPV variant B1 (SEQ ID NO:376); (iv) an amino acid sequence that is identical the M protein of a mammalian MPV variant B1 (SEQ ID NO:360); (v) an amino acid sequence that is at least 99% identical the F protein of a mammalian MPV variant B1 (SEQ ID NO:316) (vi) an amino acid sequence that is at least 98% identical the M2-1 protein of a mammalian MPV variant B1 (SEQ ID NO:340); (vii) an amino acid sequence that is at least 99% identical the M2-2 protein of a mammalian MPV variant B1 (SEQ ID NO:348); (viii) an amino acid sequence that is at least 83% identical the SH protein of a mammalian MPV variant B1 (SEQ ID NO:384); or (ix) an amino acid sequence that is at least 99% identical the L protein a mammalian MPV variant B1 (SEQ ID NO:332). In certain embodiments, the invention provides an isolated protein, wherein the protein comprises: (i) an amino acid sequence that is at least 66% identical to the G protein of a mammalian MPV variant A1 (SEQ ID NO:322); (ii) an amino acid sequence that is at least 99.5% identical to the N protein of a mammalian MPV variant A1 (SEQ ID NO:366) (iii) an amino acid sequence that is at least 96% identical to the P protein of a mammalian MPV variant A1 (SEQ ID NO:374); (iv) an amino acid sequence that is at least 99% identical to the M protein of a mammalian MPV variant A1 (SEQ ID NO:358); (v) an amino acid sequence that is at least 98% identical to the F protein of a mammalian MPV variant A1 (SEQ ID NO:314); (vi) an amino acid sequence that is at least 99% identical to the M2-1 protein of a mammalian MPV variant A1 (SEQ ID NO:338) (vii) an amino acid sequence that is at least 96% identical to the M2-2 protein of a mammalian MPV variant A1 (SEQ ID NO:346) (viii) an amino acid sequence that is at least 84% identical to the SH protein of a mammalian MPV variant A1 (SEQ ID NO:382); or (ix) an amino acid sequence that is at least 99% identical to the L protein of a virus of a mammalian MPV variant A1 (SEQ ID NO:330) In certain embodiments, the invention provides isolated protein, wherein the protein comprises (i) an amino acid sequence that is at least 66% identical to the G protein of a mammalian MPV variant A2 (SEQ ID NO:332); (ii) an amino acid sequence that is at least 99.5% identical to the N protein of a mammalian MPV variant A2 (SEQ ID NO:367); (iii) an amino acid sequence that is at least 96% identical to the P protein of a mammalian MPV variant A2 (SEQ ID NO:375) (iv) an amino acid sequence that is at least 99% identical to the M protein of a mammalian MPV variant A2 (SEQ ID NO:359); (v) an amino acid sequence that is at least 98% identical to the F protein of a mammalian MPV variant A2 (SEQ ID NO:315) (vi) an amino acid sequence that is at least 99% identical to the M2-1 protein of a mammalian MPV variant A2 (SEQ ID NO: 339); (vii) an amino acid sequence that is at least 96% identical to the M2-2 protein of a mammalian MPV variant A2 (SEQ ID NO:347) (viii) an amino acid sequence that is at least 84% identical to the SH protein of a mammalian MPV variant A2 (SEQ ID NO:383); or (ix) an amino acid sequence that is at least 99% identical to the L protein of a mammalian MPV variant A2 (SEQ ID NO:331). In certain embodiments, the invention provides an isolated protein, wherein the protein comprises: (i) an amino acid sequence that is at least 66% identical to the G protein of a mammalian MPV variant B2 (SEQ ID NO:325); (ii) an amino acid sequence that is at least 97% identical to the N protein of a mammalian MPV variant B2 (SEQ ID NO:369) (iii) an amino acid sequence that is at least 96% identical to the P protein of a mammalian MPV variant B2 (SEQ ID NO:377) (iv) an amino acid sequence that is identical to the M protein of a mammalian MPV variant B2 (SEQ ID NO:361); (v) an amino acid sequence that is at least 99% identical to the F protein of a mammalian MPV variant B2 (SEQ ID NO:317); (vi) an amino acid sequence that is at least 98% identical to the M2-1 protein of a mammalian MPV variant B2 (SEQ ID NO:341); (vii) an amino acid sequence that is at least 99% identical to the M2-2 protein of a mammalian MPV variant B2 (SEQ ID NO:349); (viii) an amino acid sequence that is at least 84% identical to the SH protein of a mammalian MPV variant B2 (SEQ ID NO:385); or (ix) an amino acid sequence that is at least 99% identical to the L protein of a mammalian MPV variant B2 (SEQ ID NO:333). In certain embodiments, the invention provides an antibody, wherein the antibody binds specifically to a protein consisting of (i) an amino acid sequence that is at least 66% identical to the G protein of a mammalian MPV variant B1 (SEQ ID NO:324); (ii) an amino acid sequence that is at least 98.5% identical to the N protein of a mammalian MPV variant B1 (SEQ ID NO:368); (iii) an amino acid sequence that is at least 96% identical the P protein of a mammalian MPV variant B1 (SEQ ID NO:376) (iv an amino acid sequence that is identical the M protein of a mammalian MPV variant B1 (SEQ ID NO:360); (v) an amino acid sequence that is at least 99% identical the F protein of a mammalian MPV variant BI (SEQ ID NO:316); (vi) an amino acid sequence that is at least 98% identical the M2-1 protein of a mammalian MPV variant B1 (SEQ ID NO:340) (vii) an amino acid sequence that is at least 99% identical the M2-2 protein of a mammalian MPV variant B1 (SEQ ID NO:348); (viii) an amino acid sequence that is at least 83% identical the SH protein of a mammalian MPV variant B1 (SEQ ID NO:384); (ix) an amino acid sequence that is at least 99% identical the L protein a mammalian MPV variant B1 (SEQ ID NO:332). In certain embodiments, the invention provides an antibody, wherein the antibody binds specifically to a protein consisting of: (i) an amino acid sequence that is at least 66% identical to the G protein of a mammalian MPV variant A1 (SEQ ID NO:322); (ii) an amino acid sequence that is at least 99.5% identical to the N protein of a mammalian MPV variant A1 (SEQ ID NO:366); (iii an amino acid sequence that is at least 96% identical to the P protein of a mammalian MPV variant A1 (SEQ ID NO:374); (iv) an amino acid sequence that is at least 99% identical to the M protein of a mammalian MPV variant A1 (SEQ ID NO:358); (v) an amino acid sequence that is at least 98% identical to the F protein of a mammalian MPV variant A1 (SEQ ID NO:314); (vi) an amino acid sequence that is at least 99% identical to the M2-1 protein of a mammalian MPV variant A1 (SEQ If) NO:338); (vii) an amino acid sequence that is at least 96% identical to the M2-2 protein of a mammalian MPV variant A1 (SEQ ID NO:346); (viii) an amino acid sequence that is at least 84% identical to the SH protein of a mammalian MPV variant A1 (SEQ ID NO:382); (ix) an amino acid sequence that is at least 99% identical to the L protein of a virus of a mammalian MPV variant A1 (SEQ ID NO:330). In certain embodiments, the invention provides an antibody, wherein the antibody binds specifically to a protein consisting of: (i) an amino acid sequence that is at least 66% identical to the G protein of a mammalian MPV variant A2 (SEQ ID NO:332); (ii) an amino acid sequence that is at least 96% identical to the N protein of a mammalian MPV variant A2 (SEQ ID NO:367) (iii) an amino acid sequence that is at least 96% identical to the P protein of a mammalian MPV variant A2 (SEQ ID NO:375); (iv) an amino acid sequence that is at least 99% identical to the M protein of a mammalian MPV variant A2 (SEQ ID NO:359); (v) an amino acid sequence that is at least 98% identical to the F protein of a mammalian MPV variant A2 (SEQ ID NO:315) (vi) an amino acid sequence that is at least 99% identical to the M2-1 protein of a mammalian MPV variant A2 (SEQ ID NO: 339); (vii) an amino acid sequence that is at least 96% identical to the M2-2 protein of a mammalian MPV variant A2 (SEQ ID NO:347); (viii) an amino acid sequence that is at least 84% identical to the SH protein of a mammalian MPV variant A2 (SEQ ID NO:383); (ix) an amino acid sequence that is at least 99% identical to the L protein of a mammalian MPV variant A2 (SEQ ID NO:331) In certain embodiments, the invention provides an antibody, wherein the antibody binds specifically to a protein consisting of: (i) an amino acid sequence that is at least 66% identical to the G protein of a mammalian MPV variant B2 (SEQ ID NO:325); (ii) an amino acid sequence that is at least 97% identical to the N protein of a mammalian MPV variant B2 (SEQ ID NO:369); (iii) an amino acid sequence that is at least 96% identical to the P protein of a mammalian MPV variant B2 (SEQ ID NO:377) (iv) an amino acid sequence that is identical to the M protein of a mammalian MPV variant B2 (SEQ ID NO:361); (v) an amino acid sequence that is at least 99% identical to the F protein of a mammalian MPV variant B2 (SEQ ID NO:317); (vi) an amino acid sequence that is at least 98% identical to the M2-1 protein of a mammalian MPV variant B2 (SEQ ID NO:341); (vii) an amino acid sequence that is at least 99% identical to the M2-2 protein of a mammalian MPV variant B2 (SEQ ID NO:349) (viii) an amino acid sequence that is at least 84% identical to the SH protein of a mammalian MPV variant B2 (SEQ ID NO:385); or (ix) an amino acid sequence that is at least 99% identical to the L protein of a mammalian MPV variant B2 (SEQ ID NO:333). In certain embodiments, the invention provides a method for detecting a variant B1 mammalian MPV in a sample, wherein said method comprises contacting the sample with the antibody of specific to a variant B1. In certain embodiments, the invention provides method for detecting a variant A1 mammalian MPV in a sample, wherein said method comprises contacting the sample with the antibody specific to variant A1, In certain embodiments, the invention provides a method for detecting a variant A2 mammalian MPV in a sample, wherein said method comprises contacting the sample with the antibody specific to variant A2. In certain embodiments, the invention provides a method for detecting a variant B2 mammalian MPV in a sample, wherein said method comprises contacting the sample with the antibody specific to B2.

In certain embodiments, the invention provides a method for identifying a viral isolate as a mammalian MPV, wherein said method comprises contacting said isolate or a component thereof with the antibody specific to a mammalian MPV. In certain embodiments, the invention provides method for virologically diagnosing a MPV infection of a mammal comprising determining in a sample of said mammal the presence of a viral isolate or component thereof by contacting the sample with the antibody specific to a MPV. In certain embodiments, the invention provides method for virologically diagnosing a mammalian MPV infection of a subject, wherein said method comprises obtaining a sample from the subject and contacting the sample with an antibody specific to MPV wherein if the antibody binds to the sample the subject is infected with mammalian MPV.

In certain embodiments, the invention provides an infectious recombinant virus, wherein the recombinant virus comprises the genome of a mammalian MPV and further comprises a non-native MPV sequence. In certain embodiments, the invention provides a recombinant nucleic acid, wherein the recombinant nucleic acid comprises (i) a nucleic acid encoding a G polypeptide of an MPV A1 variant; and (ii) a nucleic acid encoding a non-native MPV polypeptide. In certain embodiments, the invention provides recombinant nucleic acid, wherein the recombinant nucleic acid comprises (i) a nucleic acid encoding a G polypeptide of an MPV A2 variant; and (ii) a nucleic acid encoding a non-native MPV polypeptide. In certain embodiments, the invention provides s recombinant nucleic acid, wherein the recombinant nucleic acid comprises (i) a nucleic acid encoding a G polypeptide of an MPV B1 variant; and (ii) a nucleic acid encoding a non-native MPV polypeptide. In certain embodiments, the invention provides a recombinant nucleic acid, wherein the recombinant nucleic acid comprises (i) a nucleic acid encoding a G polypeptide of an MPV B2 variant; and (ii) a nucleic acid encoding a non-native MPV polypeptide.

In certain embodiments, the invention provides an infectious chimeric virus, wherein the chimeric virus comprises the genome of a mammalian MPV of a first variant, wherein one or more of the open reading frames in the genome of the mammalian MPV of the first variant have been replaced by the analogous open reading frame from a mammalian MPV of a second variant. In certain embodiments, the invention provides an infectious chimeric virus, wherein the chimeric virus comprises the genome of a mammalian MPV of a first variant, wherein one or more of open reading frames of a mammalian MPV of a second variant are inserted into the genome of the mammalian MPV of the first variant.

In certain embodiments, the invention provides an infectious chimeric virus, wherein the chimeric virus comprises the genome of a mammalian MPV, wherein one or more of the open reading frames in the genome of the mammalian MPV have been replaced by an ORF which encodes one or more of an avian MPV F protein; an avian MPV G protein (iii) an avian MPV SH protein; (iv) an avian MPV N protein (v) an avian MPV P protein; (vi) an avian MPV M2 protein;(vii) an avian MPV M2-1 protein; (viii) an avian MPV M2-2 protein; or (ix) an avian MPV L protein. In certain embodiments, the invention provides an infectious chimeric virus, wherein the chimeric virus comprises the genome of an avian MPV, wherein one or more of the open reading frames in the genome of the avian MPV have been replaced by an ORF which encodes one or more of (i) a mammalian MPV F protein (ii) a mammalian MPV G protein; (iii) a mammalian MPV SH protein; (iv) a mammalian MPV N protein; (v) a mammalian MPV P protein; (vi) a mammalian MPV M2 protein; (vii) a mammalian MPV M2-1 protein; (viii) a mammalian MPV M2-2 protein; or (ix) a mammalian MPV L protein.

In certain embodiments, the invention provides an immunogenic composition, wherein the immunogenic composition comprises the infectious recombinant virus of the invention.

In certain embodiments, the invention provides a method for detecting a mammalian MPV in a sample, wherein the method comprises contacting the sample with a nucleic acid sequence of the invention. In certain embodiments, the invention provides a pharmaceutical composition, wherein the pharmaceutical composition comprises the infectious recombinant virus of the invention.

In certain embodiments, the invention provides a method for treating or preventing a respiratory tract infection in a mammal, said method comprising administering a vaccine comprising a mammalian *metapneumovirus*.

In certain embodiments, the invention provides an method for treating or preventing a respiratory tract infection in a mammal, said method comprising administering a vaccine comprising the recombinant mammalian *metapneumovirus* of the invention.

In certain embodiments, the invention provides an method for treating or preventing a respiratory tract infection in a mammal, said method comprising administering a vaccine comprising avian *metapneumovirus*. In certain embodiments, the invention provides a method for treating or preventing a respiratory tract infection in a human, said method comprising administering a vaccine comprising avian *metapneumovirus*. In certain embodiments, the invention provides a method for treating or preventing a respiratory tract infection in a subject, said method comprising administering to the subject the composition of the invention.

In certain embodiments, the invention provides a method for identifying a compound useful for the treatment of infections with mammalian MPV, wherein the method comprises: (a) infecting an animal with a mammalian MPV; (b) Administering to the animal a test compound; and (c) determining the effect of the test compound on the infection of the animal, wherein a test compound that reduces the extent of the infection or that ameliorates the symptoms associated with the infection is identified as a compound useful for the treatment of infections with mammalian MPV. In certain embodiments, the invention provides a method for identifying a compound useful for the treatment of infections with mammalian MPV, wherein the method comprises (a) infecting a cell culture with a mammalian MPV (b) incubating the cell culture with a test compound; and (c) determining the effect of the test compound on the infection of the cell culture, wherein a test compound that reduces the extent of the infection is identified as a compound useful for the treatment of infections with mammalian MPV. In certain embodiments, the invention provides a method for diagnosing a mammalian MPV infection of an animal, wherein the method comprises determining in a sample of said animal the presence of a viral isolate or component thereof by reacting said sample with a nucleic acid or an antibody reactive with a component of an avian pneumovirus, said nucleic acid or antibody being cross-reactive with a component of MPV.

In certain embodiments, the invention provides a method for serologically diagnosing a mammalian MPV infection of an animal, wherein the method comprises contacting a sample from the animal with the protein of the invention. In certain embodiments, the invention provides a method for serologically diagnosing a mammalian MPV infection of an animal, wherein the method comprises contacting a sample from the animal with a protein of an APV. In certain embodiments, the invention provides an method for diagnosing an APV infection of a bird comprising contacting a sample from the animal with the protein of the invention.

In certain embodiments, the invention provides an isolated negative-sense single stranded RNA virus MPV belonging to the sub-family Pneumovirinae of the family Paramyxoviridae and identifiable as phylogenetically corresponding to the genus *Metapneumovirus*, wherein the virus is phylogenetically more closely related to a virus isolate deposited as I-2614 with CNCM, Paris than to turkey rhinotracheitis virus, the etiological agent of avian rhinotracheitis.

3.1 Conventions and Abbreviations

| | |
|---|---|
| cDNA | complementary DNA |
| L | large protein |
| M | matrix protein (lines inside of envelope) |
| F | fusion glycoprotein |
| HN | hemagglutinin-neuraminidase glycoprotein |
| N, NP or NC | nucleoprotein (associated with RNA and required for polymerase activity) |
| P | phosphoprotein |
| MOI | multiplicity of infection |
| NA | neuraminidase (envelope glycoprotein) |
| PIV | parainfluenza virus |
| hPIV | human parainfluenza virus |
| hPIV3 | human parainfluenza virus type 3 |
| APV/hMPV | recombinant APV with hMPV sequences |
| hMPV/APV | recombinant hMPV with APV sequences |
| Mammalian MPV | mammalian metapneumovirus |
| nt | nucleotide |
| RNP | ribonucleoprotein |
| rRNP | recombinant RNP |
| vRNA | genomic virus RNA |
| cRNA | antigenomic virus RNA |
| hMPV | human metapneumovirus |
| APV | avian pneumovirus |
| MVA | modified vaccinia virus Ankara |
| FACS | Fluorescence Activated Cell Sorter |
| CPE | cytopathic effects |
| Position 1 | Position of the first gene of the viral genome to be transcribed |
| Position 2 | Position between the first and the second open reading frame of the native viral genome, or alternatively, the position of the second gene of the viral genome to be transcribed |
| Position 3 | Position between the second and the third open reading frame of the native viral genome, or alternatively, the position of the third gene of the viral genome to be transcribed. |
| Position 4 | Position between the third and the fourth open reading frame of the native viral genome, or alternatively, the position of the fourth gene of the viral genome to be transcribed. |
| Position 5 | Position between the fourth and the fifth open reading frame of the native viral genome, or alternatively, the position of the fifth gene of the viral genome to be transcribed. |
| Position 6 | Position between the fifth and the sixth open reading frame of the native viral genome, or alternatively, the position of the sixth gene of the viral genome to be transcribed. |

4. DESCRIPTION OF THE FIGURES

FIG. 1: Percentage homology found between the amino acid sequence of isolate 00-1 and other members of the Pneumovirinae. Percentages (x100) are given for the amino acid sequences of N, P, M, F and two RAP-PCR fragments in L (8 and 9/10).

FIG. 2: Seroprevalence of MPV in humans categorized by age group, using immunofluorescence and virus neutralisation assays.

FIG. 3: Schematic representation of the genome of APV with the location and size of the fragments obtained with RAP-PCR and RT-PCR on virus isolate 00-1 (A1). Fragments 1 to 10 were obtained using RAP-PCR. Fragment A was obtained with a primer in RAP-PCR fragment 1 and 2 and a primer that was designed based on alignment of leader and trailer sequences of APV and RSV (Randhawa et al., 1997, J. Virol. 71:9849-9854). Fragment B was obtained using primers designed in RAP-PCR fragment 1 and 2 and RAP-PCR fragment 3. Fragment C was obtained with primers designed in RAP-PCR fragment 3 and RAP-PCR fragments 4, 5, 6, and 7.

FIG. 4: Comparison of the N, P, M and F ORFs of members of the subfamily Pneumovirinae and virus isolate 00-1 (A1). The alignment shows the amino acid sequence of the complete N, F, M and P proteins and partial L proteins of virus isolate 00-1 (A1). Amino acids that differ between isolate 00-1 (A1) and the other viruses are shown, identical amino acids are represented by periods. Gaps are represented as dashes. Numbers correspond to amino acid positions in the proteins. Abbreviations are as follows: APV-A, B or C: Avian Pneumovirus type A, B or C; hRSV: bovine or human respiratory syncytial virus; PVM: pneumonia virus of mice. L8: fragment 8 obtained with RAP-PCR located in L, L 9/10: consensus of fragment 9 and 10 obtained with RAP-PCR, located in L. For the L alignment only bRSV, hRSV and APV-A sequences were available.

FIG. 5: Alignment of the predicted amino acid sequence of the nucleoprotein of MPV with those of other pneumoviruses. The conserved regions are represented by boxes and labeled A, B, and C. The conserved region among pneumoviruses is shown in gray and shaded. Gaps are represented by dashes, periods indicate the positions of identical amino acid residues compared to MPV.

FIG. 6: Amino acid sequence comparison of the phosphoprotein of MPV with those of other pneumoviruses. The region of high similarity is boxed, and the glutamate rich region is in grey and shaded. Gaps are represented by dashes. Periods indicate the position of identical amino acid residues compared to MPV.

FIG. 7: Comparison of the deduced amino acid sequence of the matrix protein of MPV with those of other pneumoviruses. The conserved hexapeptide sequence is in grey and shaded. Gaps are represented by dashes. Periods indicate the position of identical amino acid residues relative to MPV.

Figure 8:
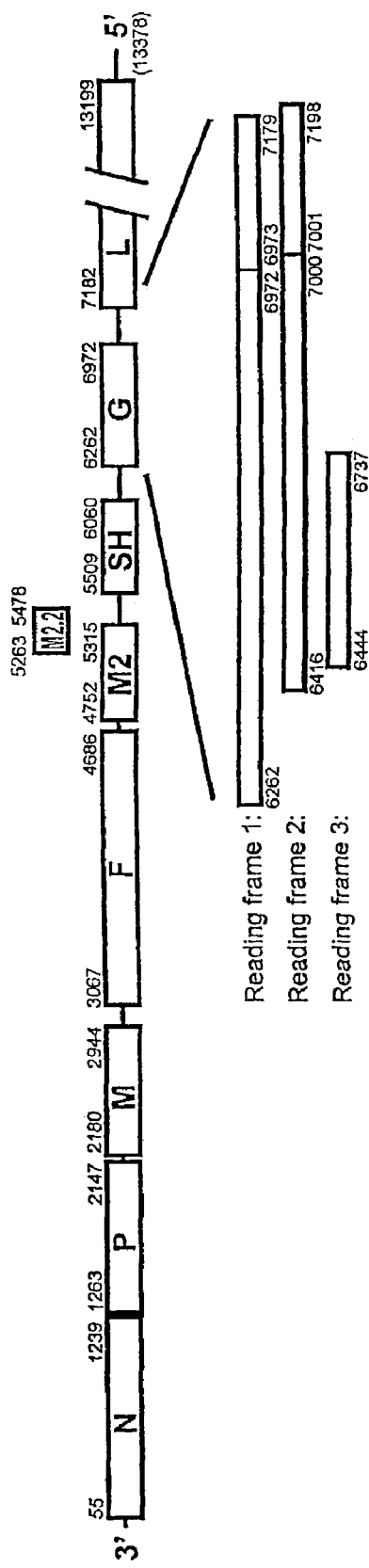

FIG. 8: Genomic map of MPV isolate 00-1 (A1). The nucleotide positions of the start and stop codons are indicated under each ORF. The double lines which cross the L ORF indicate the shortened representation of the L gene. The three reading frames below the map indicate the primary G ORF (nt 6262-6972) and overlapping potential secondary ORFs.

FIG. 9: Alignment of the predicted amino acid sequence of the fusion protein of MPV with those of other pneumoviruses. The conserved cysteine residues are boxed. N-linked glycosylation sites are underlined. The cleavage site of F0 is double underlined; the fusion peptide, signal peptide, and membrane anchor domain are shown in grey and shaded. Gaps are represented by dashes, and periods indicate the position of identical amino acids relative to MPV.

FIG. 10: Comparison of amino acid sequences of the M2 ORFs of MPV with those of other pneumoviruses. The alignment of M2-1 ORFs is shown in panel A, with the conserved amino terminus shown in grey and shaded. The three conserved cysteine residues are printed bold face and indicated by #. The alignment of the M2-2 ORFs is shown in panel B. Gaps are represented by dashes and periods indicate the position of identical amino acids relative to MPV.

Figure 11:
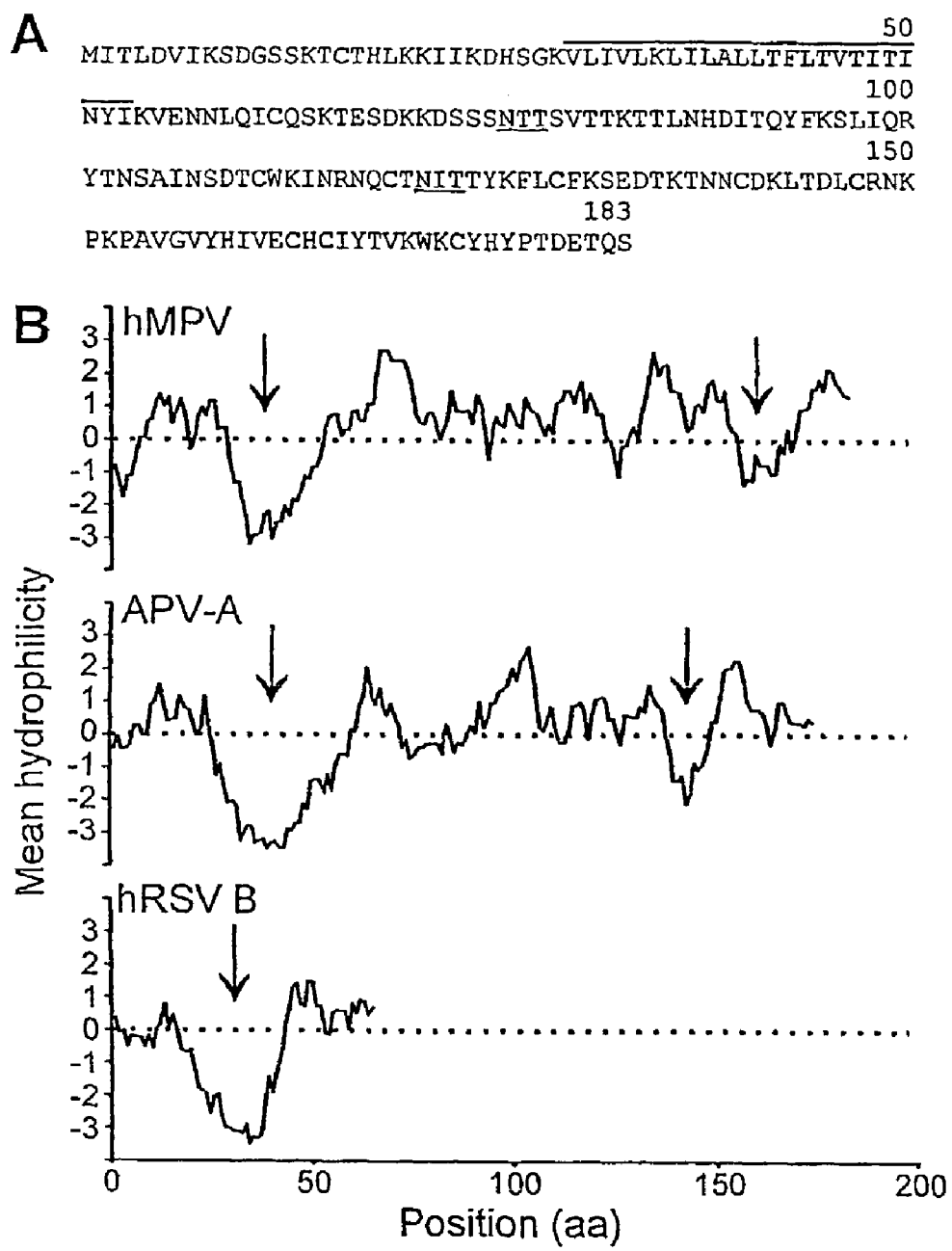

FIG. 11: Amino acid sequence analyses of the SH ORF of MPV. (A) Amino acid sequence of the SH ORF of MPV, with the serine and threonine residues in grey and shaded, cysteine residues in bold face, and the hydrophobic region doubly underlined. Potential N-linked glycosylation sites are single underlined. Arrows indicate the positions of the basic amino acids flanking the hydrophobic domain. (B) Alignment of the hydrophobicity plots of the SH proteins of MPV, APV-A and hRSV-B. A window of 17 amino acids was used. Arrows indicate a strong hydrophobic domain. Positions within the ORF are given on the X-axis.

Figure 12:
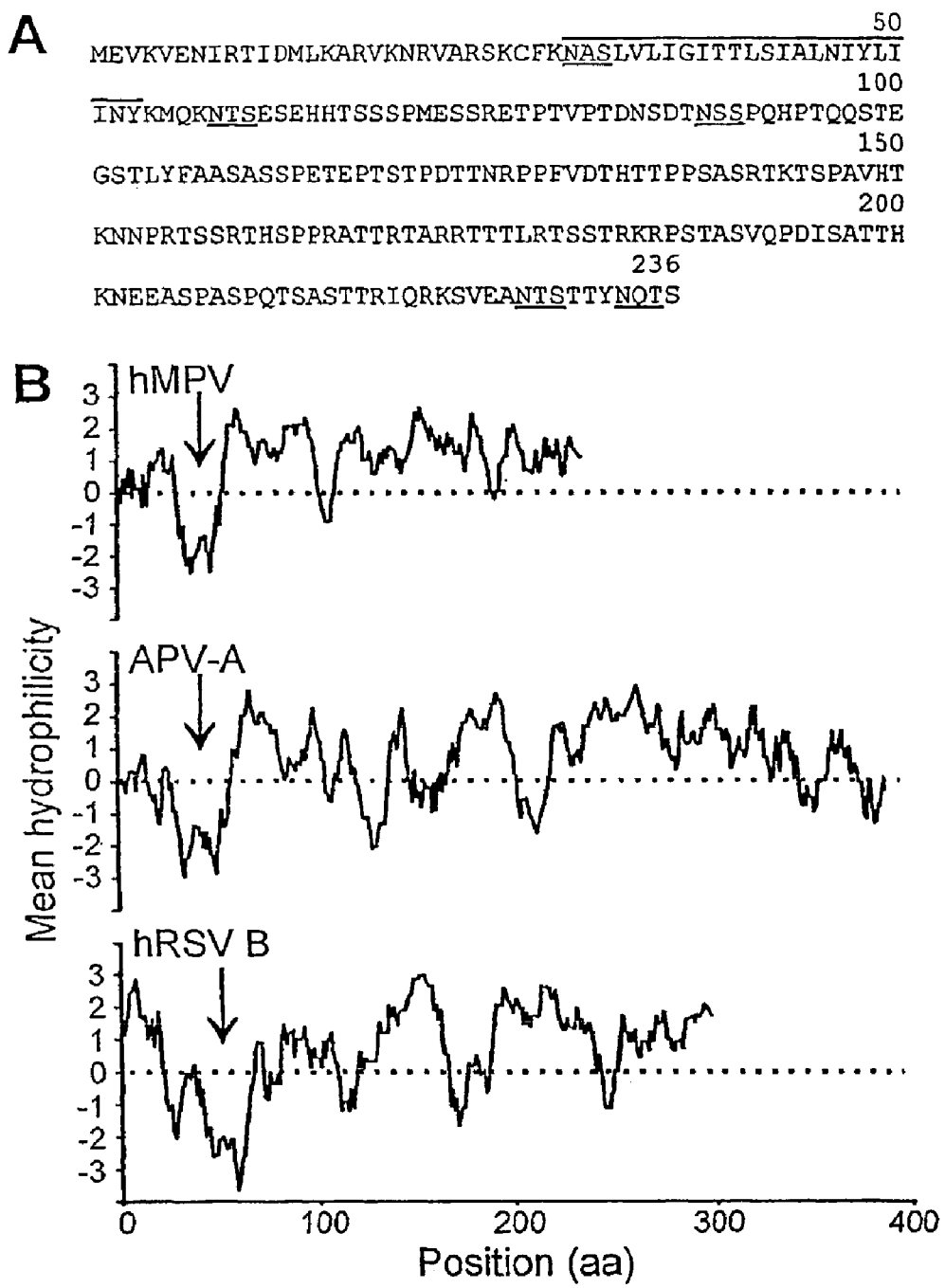

FIG. 12: Amino acid sequence analyses of the G ORF of MPV. (A) Amino acid sequence of the G ORF of MPV, with serine, threonine, and proline residues in grey and shaded. The cysteine residue is in bold face, and the hydrophobic region is doubly underlined. The potential N-linked glycosylation sites are singly underlined. (B) Alignment of the hydrophobicity plots of the G proteins of MPV, APV-A and hRSV-B. A window of 17 amino acids was used. Arrows indicate the hydrophobic region, and positions within the ORF are given at the X-axis.

FIG. 13: Comparison of the amino acid sequences of a conserved domain of the polymerase gene of MPV and other paramyxoviruses. Domain III is shown with the four conserved polymerase motifs (A, B, C, D) in domain III (Poch et al., 1989 EMBO J 8:3867-74; Poch et al., 1990, J. Gen. Virol 71:1153-62) boxed. Gaps are represented by dashes and periods indicate the position of identical amino acid residues relative to MPV. Abbreviations used are as follows: hPIV-3: human parainfluenza virus type 3; SV: sendai virus; hPIV-2: human parainfluenza virus type 2; NDV: New castle disease virus; MV: measles virus; nipah: Nipah virus.

Figure 14:
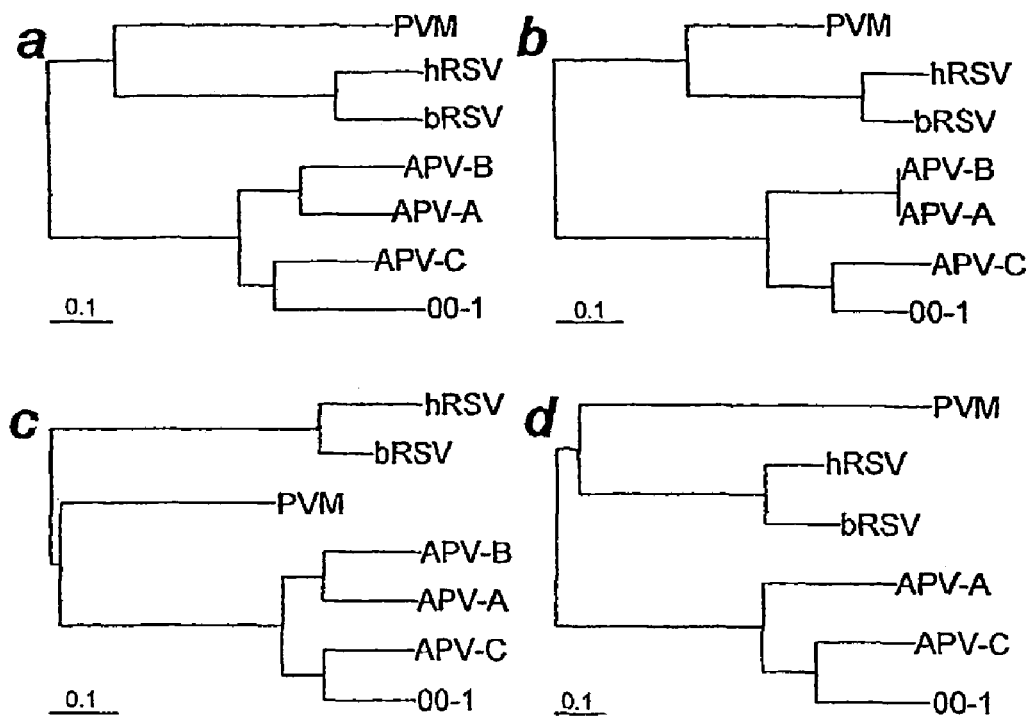

FIG. 14: Phylogenetic analyses of the N, F, M, and F ORF s of members of the genus Pneumovirinae and virus isolate 00-1 (A1). Phylogenetic analysis was performed on viral sequences from the following genes: F (panel A), N (panel B), M (panel C), and P (panel D). The phylogenetic trees are based on maximum likelihood analyses using 100 bootstraps and 3 jumbles. The scale representing the number of nucleotide changes is shown for each tree.

Figure 15:
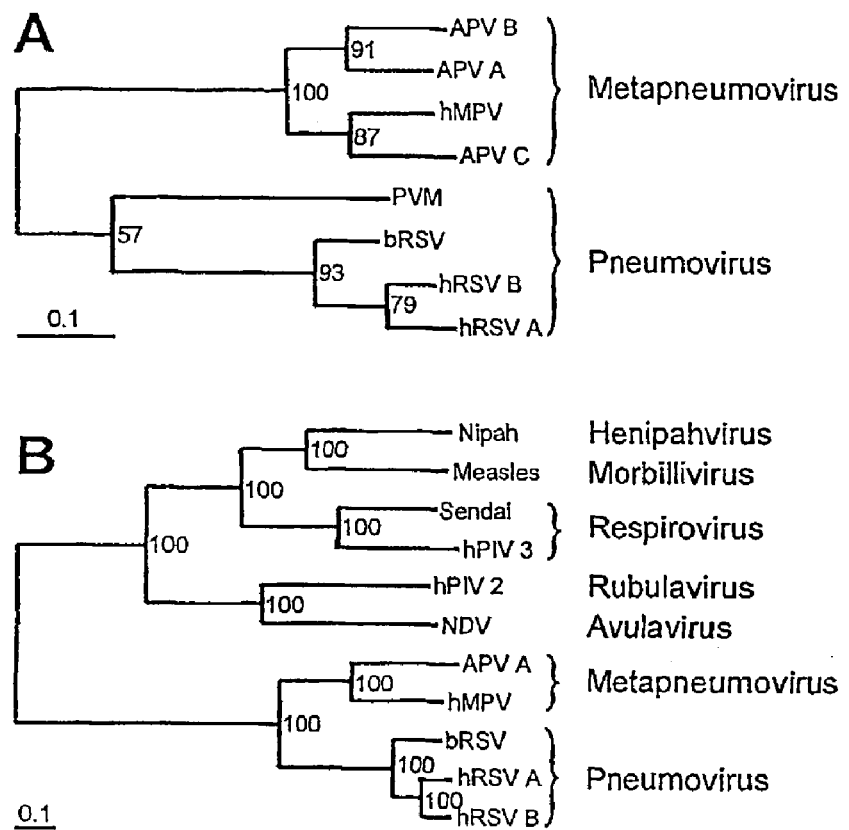

FIG. 15: Phylogenetic analyses of the M2-1 and L ORFs of MPV and selected paramyxoviruses. The M2-1 ORF was aligned with the M2-1 ORFs of other members of the genus Pneumovirinae (A) and the L ORF was aligned with L ORFs members of the genus pneumovirinae and selected other paramyxoviruses as described in the legend of FIG. 13. Phylogenetic trees were generated by maximum likelihood analyses using 100 bootstraps and 3 jumbles. The scale representing the number of nucleotide changes is shown for each tree. Numbers in the trees represent bootstrap values based on the consensus trees.

Figure 16:
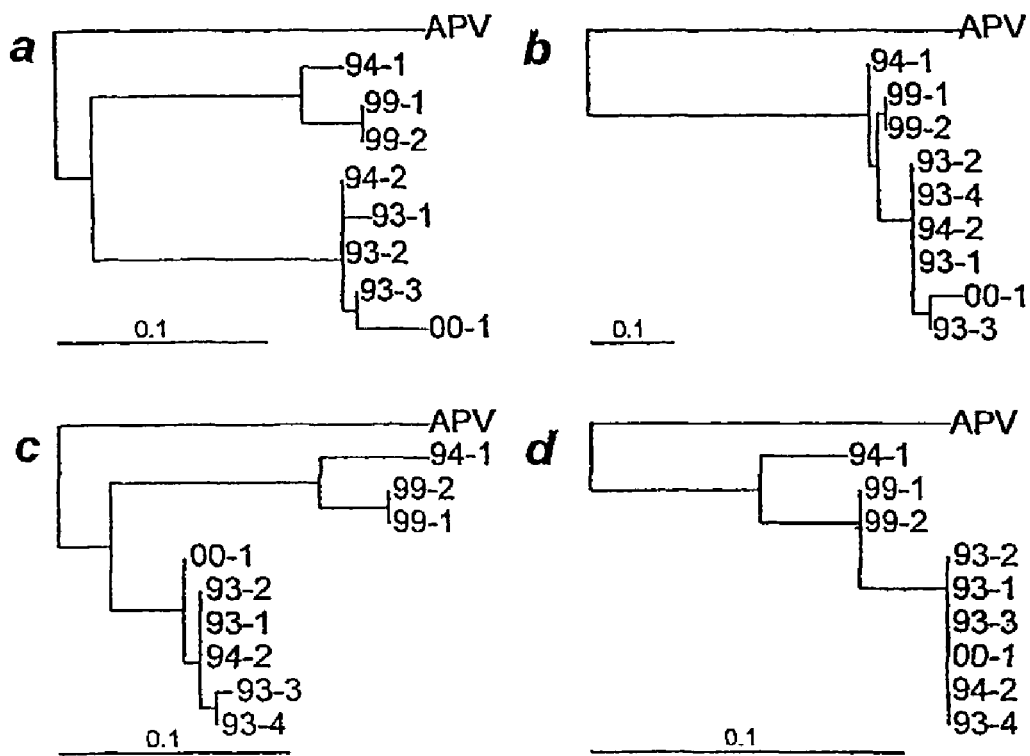

FIG. 16: Phylogenetic relationship for parts of the F (panel A), N (panel B), M (panel C) 20 and L (panel D) ORFs of nine of the primary MPV isolates with APV-C, its closest relative genetically. The phylogenetic trees are based on maximum likelihood analyses. The scale representing the number of nucleotide changes is shown for each tree. Accession numbers for APV-C: panel A: D00850; panel B: U39295; panel C: X58639; and panel D: U65312.

FIG. 17: Alignment of the F genes of different isolates of hMPV of all four variants, variant A1, A2, B1, or B2.

FIG. 18: Alignment of the F proteins of different isolates of hMPV of all four variants, variant A1, A2, B1, or B2.

FIG. 19: Alignment of the G genes of different isolates of hMPV of all four variants, variant A1, A2, B1, or B2.

FIG. 20: Alignment of the G proteins of different isolates of hMPV of all four variants, variant A1, A2, B1, or B2.

Figure 21:
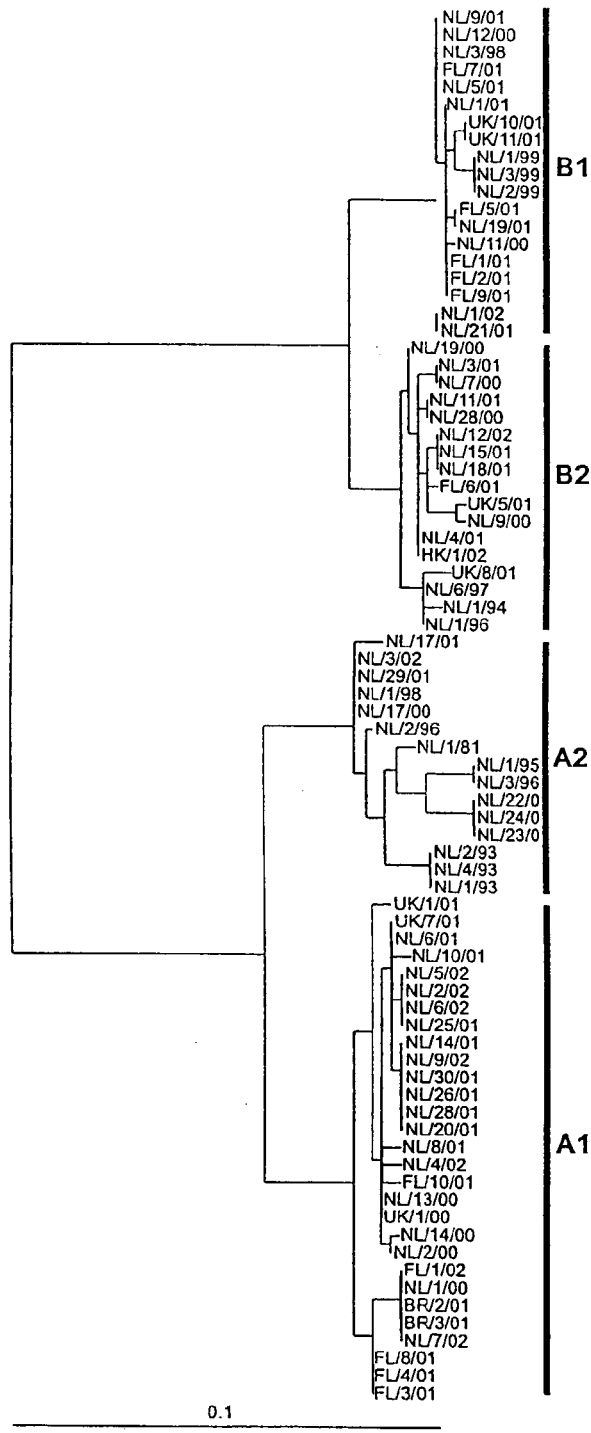

FIG. 21: Phylogenetic tree based on the F gene sequences showing the phylogenetic relationship of the different hMPV isolates with the respective variants of hMPV.

Figure 22:
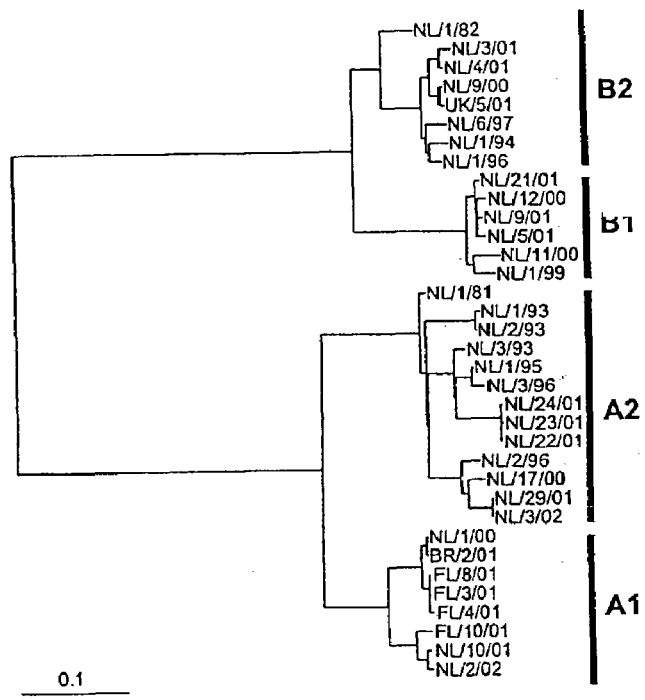

FIG. 22: Phylogenetic tree based on the G gene sequences showing the phylogenetic relationship of the different hMPV isolates with the respective variants of hMPV is shown in FIG. 13.

FIG. 23: Growth curve of hMPV isolate 00-1 (A1) in Vero cells. The Vero cells were infected at a MOI of 0.1.

FIG. 24: Sequence of CAT-hMPV minireplicon construct. The function encoded by a segment of sequence is indicated underneath the sequence.

FIG. 25: Expression of CAT from the CAT-hMPV minireplicon. The different constructs used for transfection are indicated on the x-axis; the amount of CAT expression is indicated on the y-axis. The Figure shows CAT expression 24 hours after transfection and CAT expression 48 hours after transfection. Standards were dilutions of CAT protein.

FIG. 26: Leader and Trailer Sequence Comparison: Alignments of the leader and trailer sequences of different viruses as indicated are shown.

Figure 27:
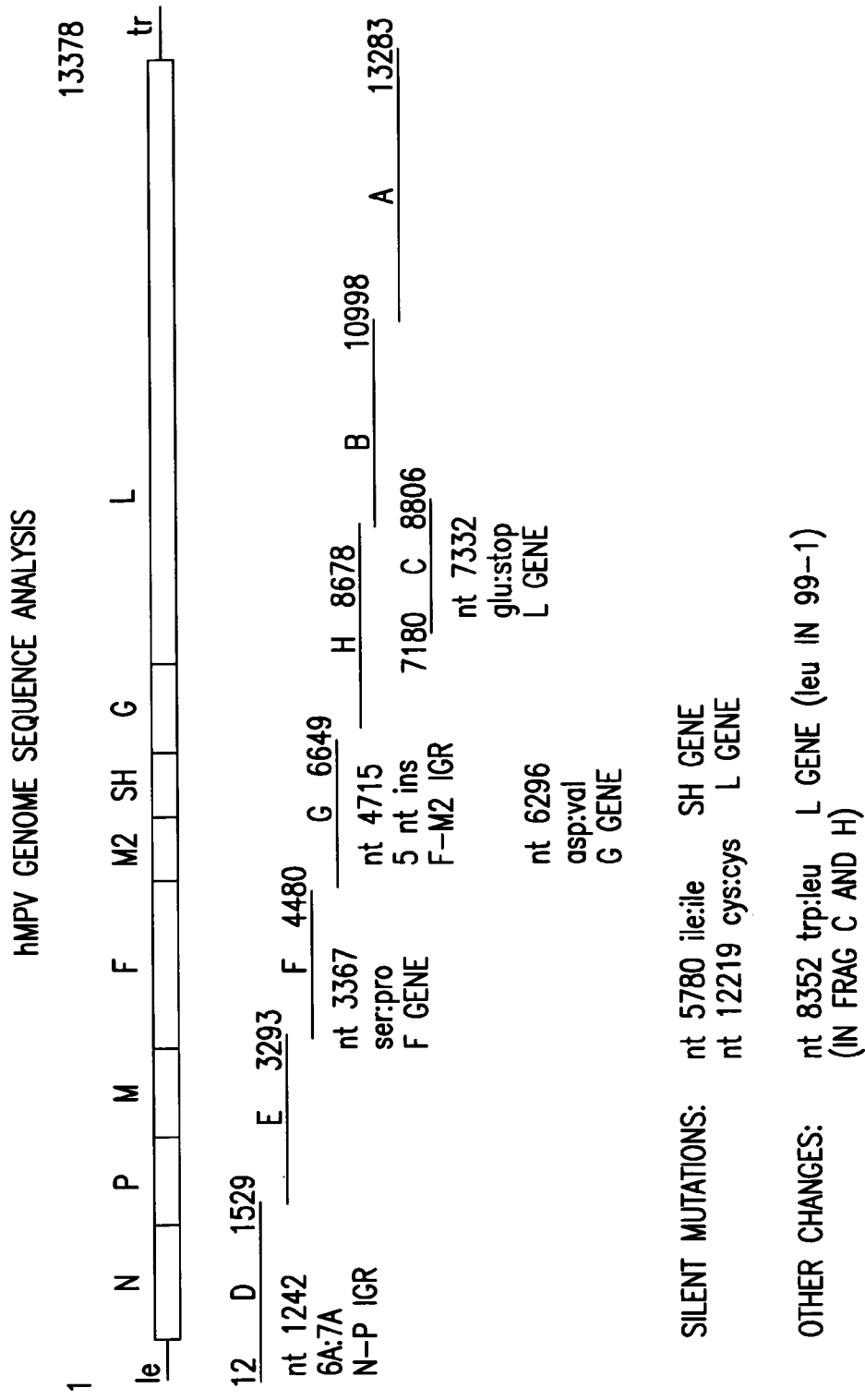

FIG. 27: hMPV genome analysis: PCR fragments of hMPV genomic sequence relative to the hMPV genomic organization are shown. The position of mutations are shown underneath the vertical bars indicating the PCR fragments.

Figure 28:
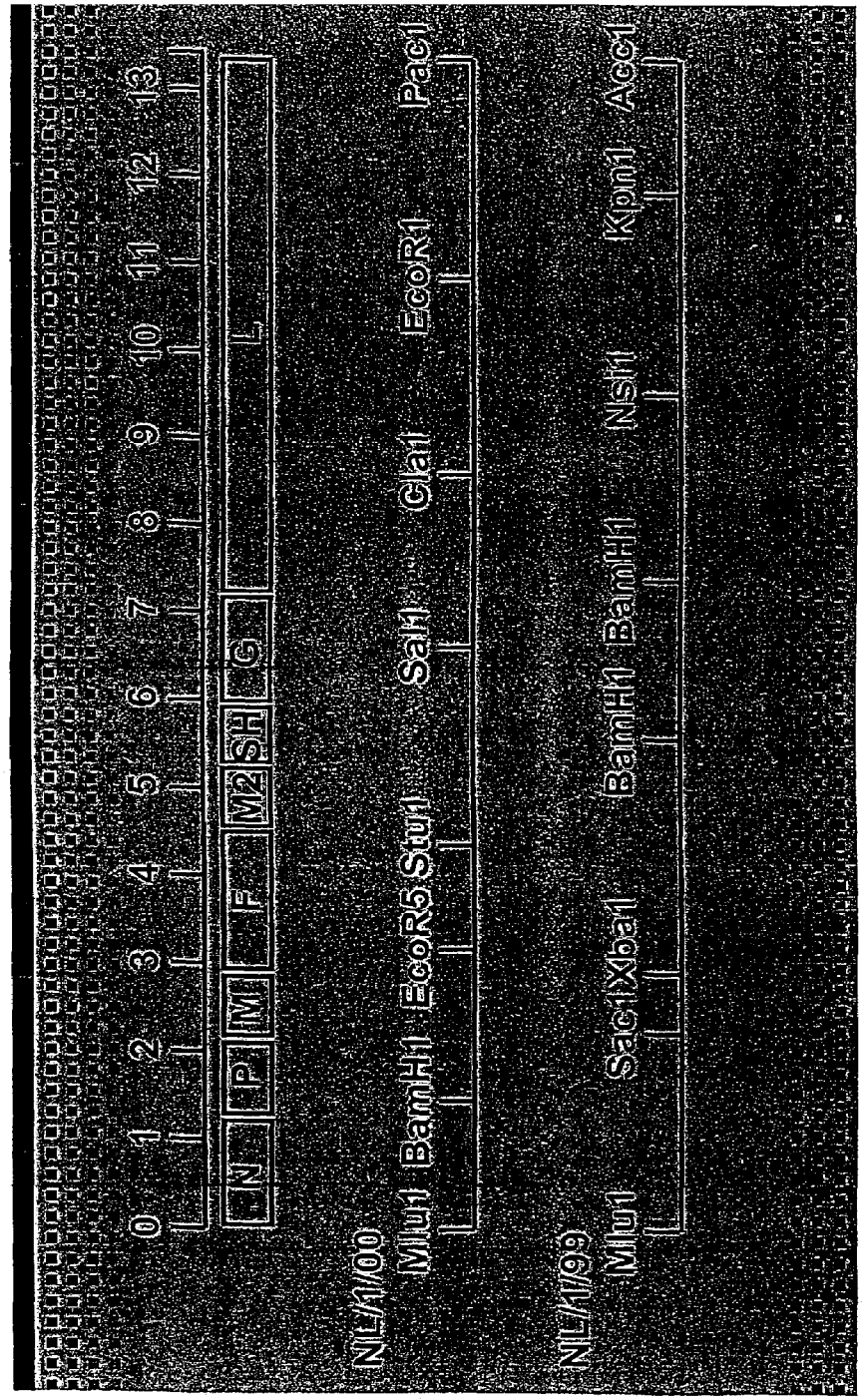

FIG. 28: Restriction maps of hMPV isolate 00-1 (A1) and hMPV isolate 99-1 (B1). Restriction sites in the respective isolates are indicated underneath the diagram showing the genomic organization of hMPV. The scale on top of the diagram indicates the position in the HMPV genome in kb.

Figure 29A:
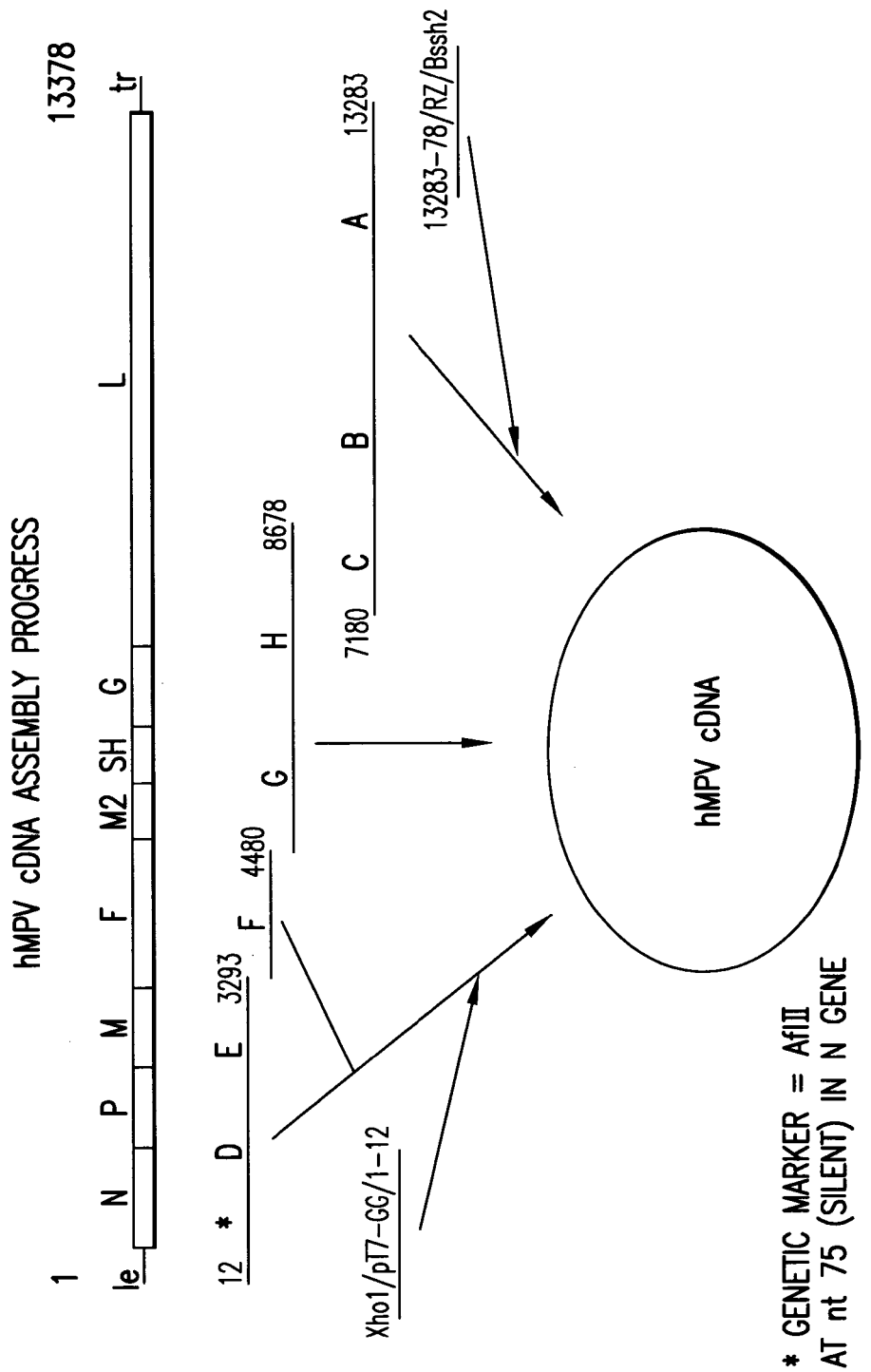
Figure 29B:
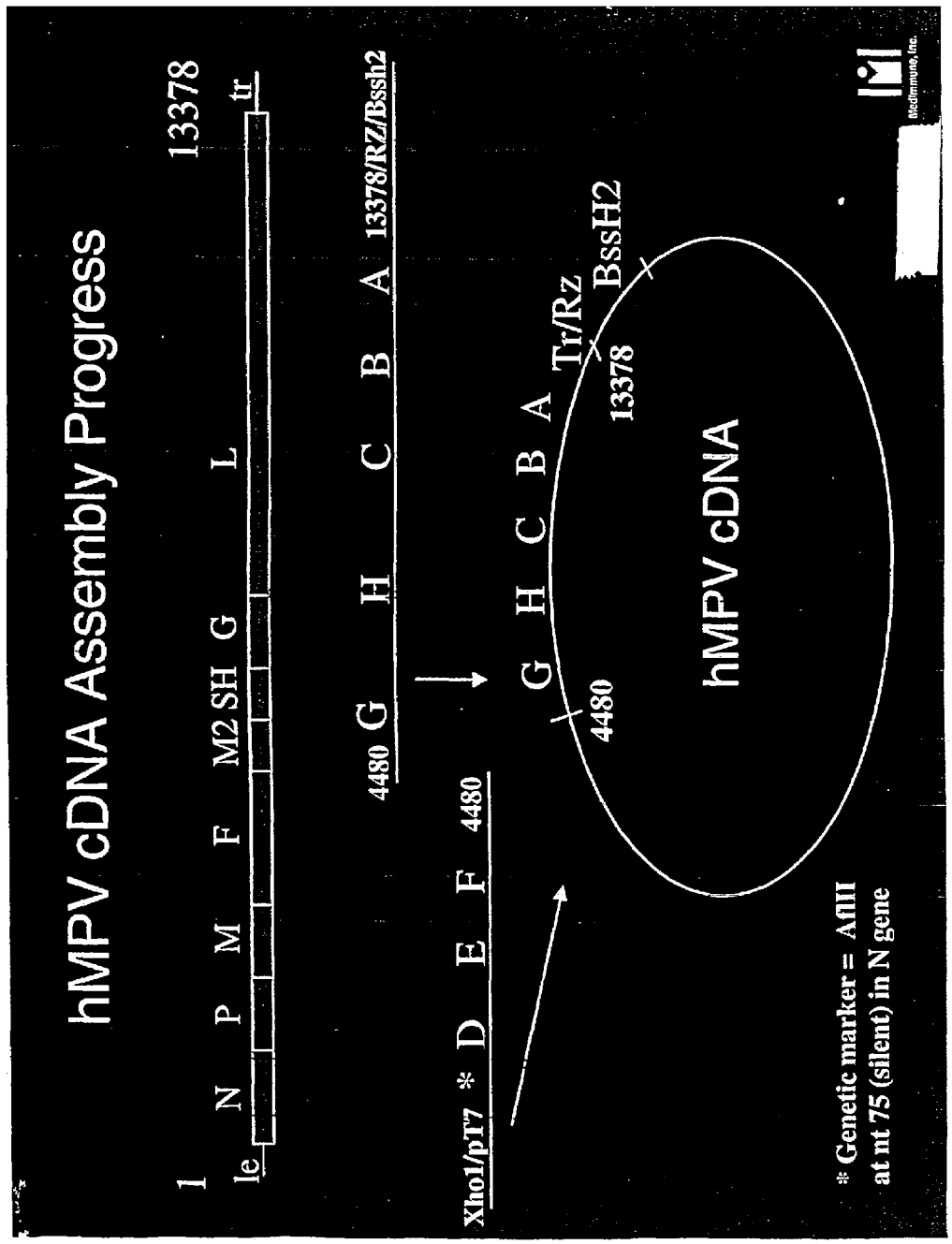

FIGS. 29A and 29B: hMPV cDNA assembly. The diagram on top shows the genomic organization of hMPV, the bars underneath indicate the PCR fragments (see FIG. 27) that are assembled to result in a full length cDNA encoding the virus. The numbers on top of the bars representing the PCR fragments indicate the position in the viral genome in basepairs.

Figure 30:
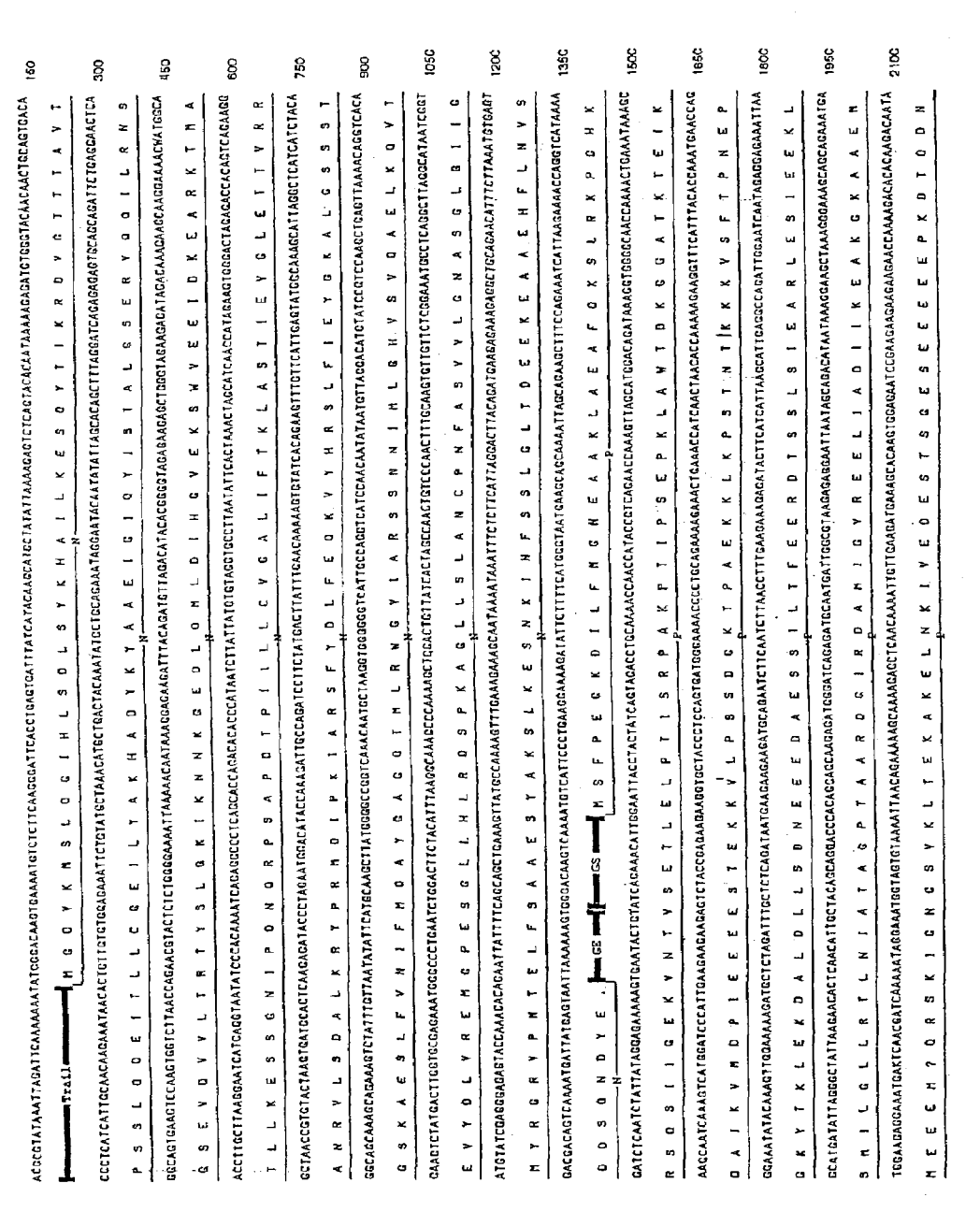
Figure 30:
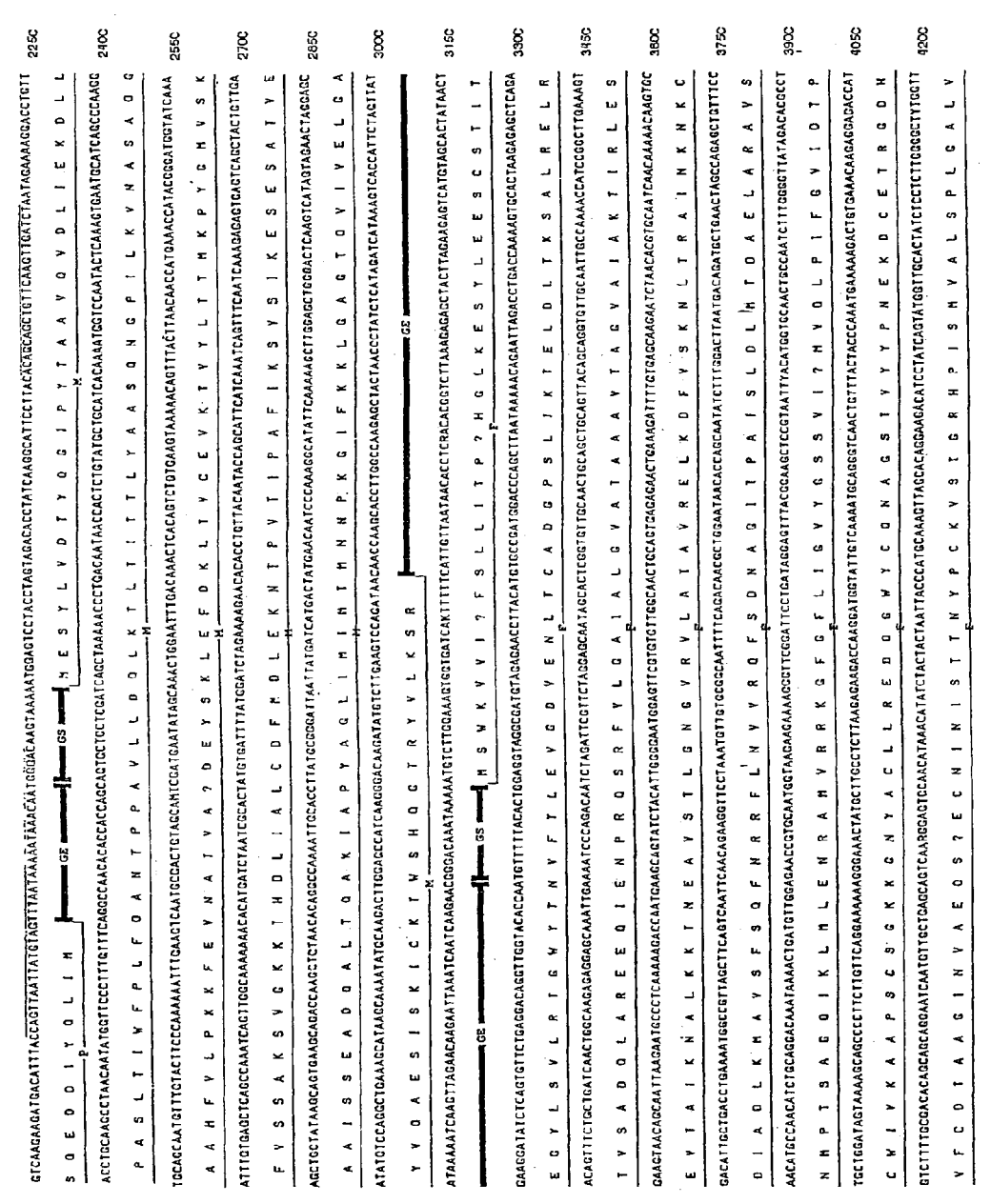
Figure 30:
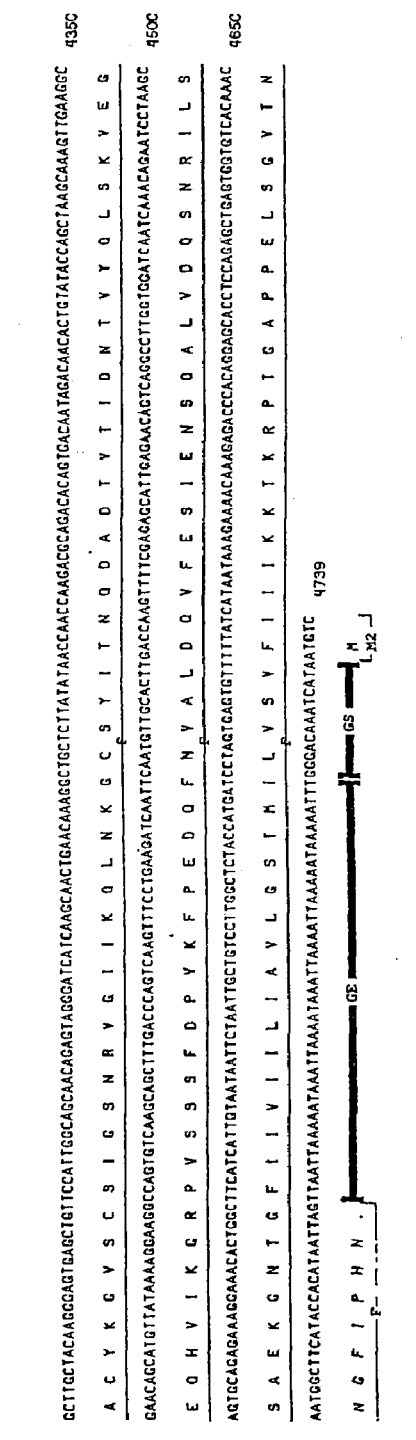

FIG. 30: Nucleotide and amino acid sequence information from the 3' end of the genome of MPV isolate 00-1 (A1). ORFs are given. N: ORF for nucleoprotein; P: ORF for phosphoprotein; M: ORF for matrix protein; F: ORF for fusion protein; GE: gene end; GS: gene start.

Figures 31A, 31B:
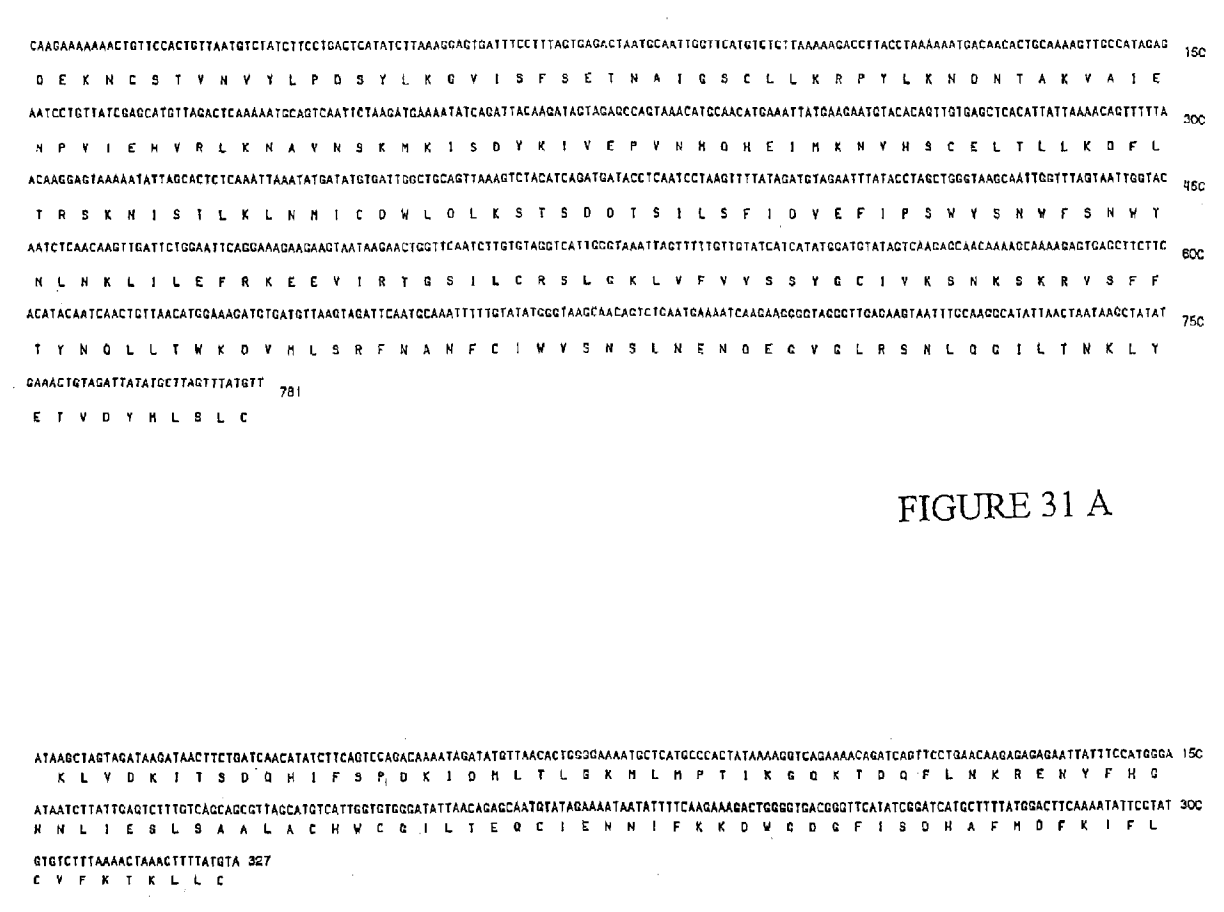

FIGS. 31A and B: Nucleotide and amino acid sequence information from obtained fragments in the polymerase gene (L) of MPV isolates 00-1 (A1). Positioning of the fragments in L is based on protein homologies with APV-A (accession number U65312). The translated fragment 8 (FIG. 31A) is located at amino acid number 8 to 243, and the consensus of fragments 9 and 10 (FIG. 31B) is located at amino acid number 1358 to 1464 of the APV-A L ORF.

FIG. 32: Results of RT-PCR assays on throat and nose swabs of 12 guinea pigs 15 inoculated with ned/00/01 (A1) and/or ned/99/01 (B1).

Figure 33A:
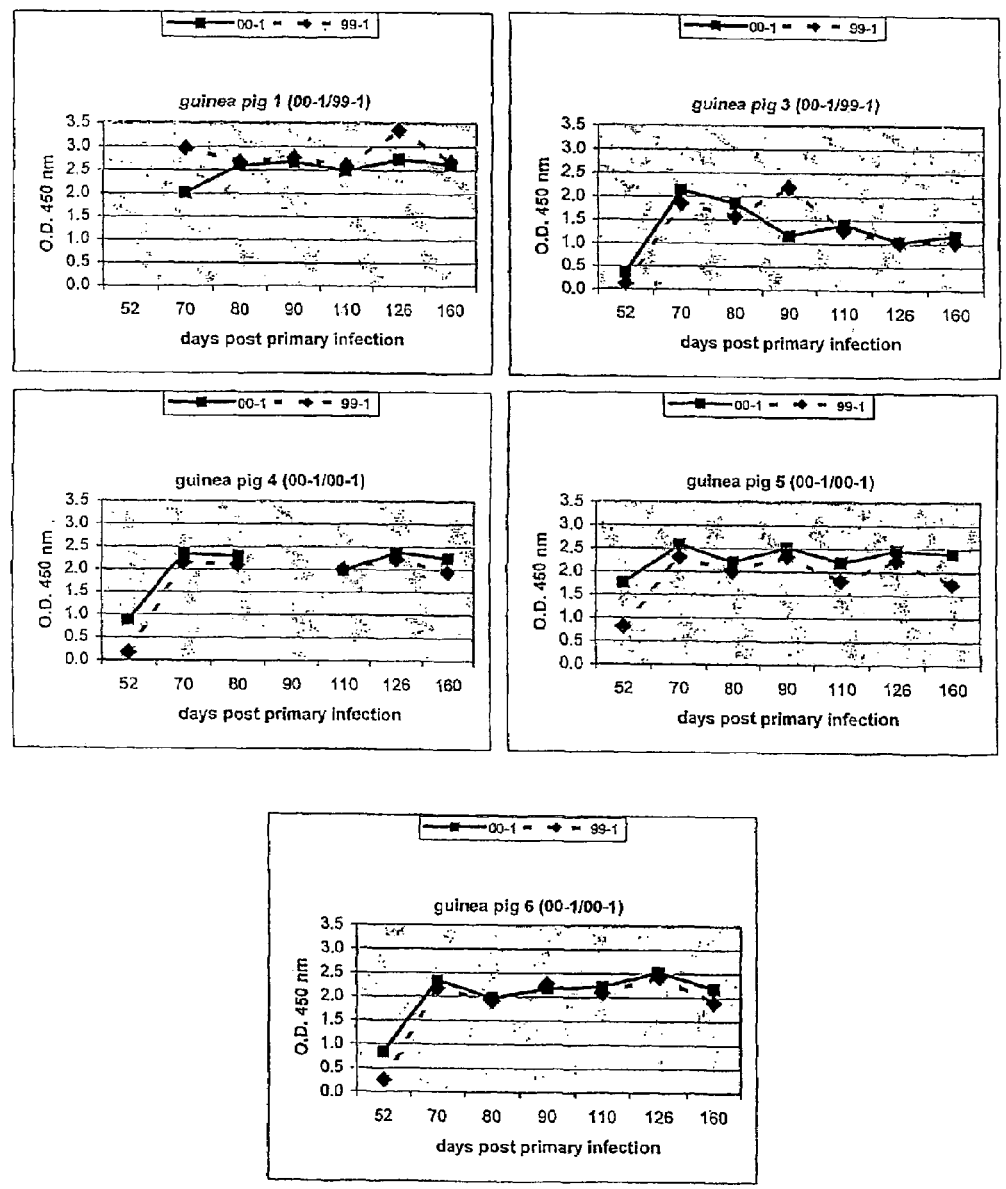

FIG. 33A: IgG response against ned/00/01 (A1) and ned/99/01 (B1) for guinea pigs infected with ned/00/01 (A1) and re-infected with ned/00/01 (A1) (GP 4, 5 and 6) or ned/99/01 (B1) (GP 1 and 3).

Figure 33B:
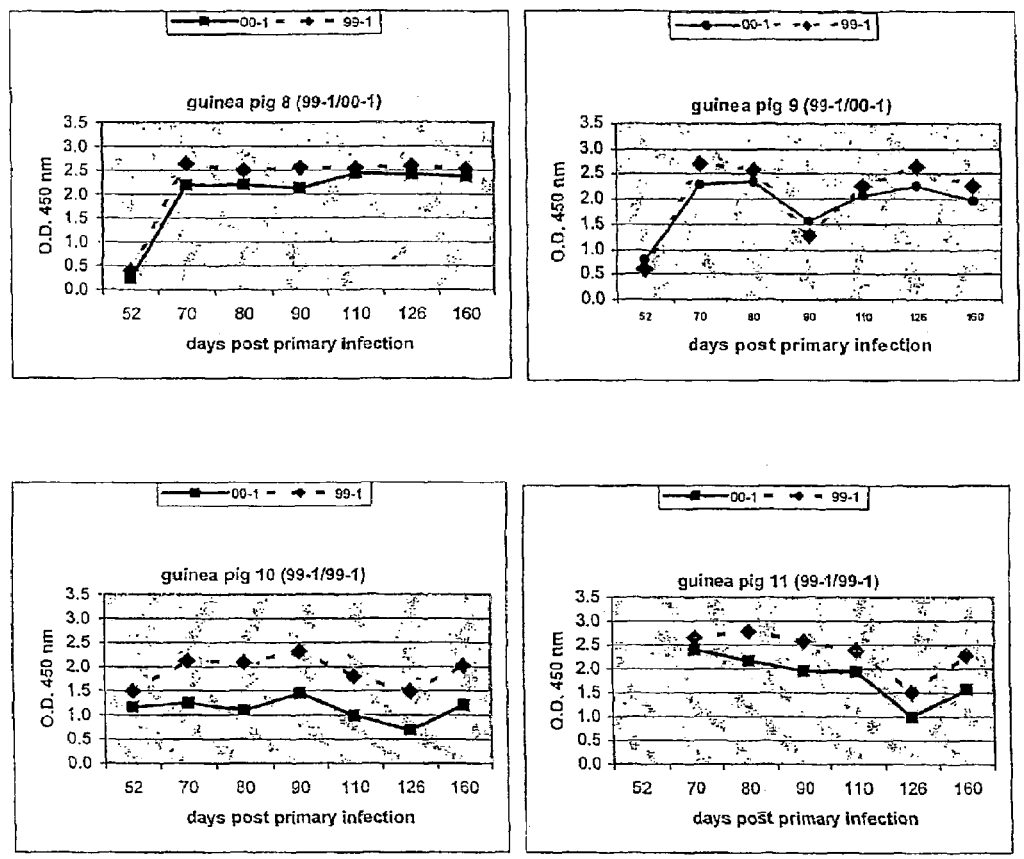

FIG. 33B: IgG response against ned/00/01 (A1) and ned/99/01 (B1) for guinea pigs infected with ned/99/01 and re-infected with either ned/00/01 (A1) (GP's 8 and 9) or with ned/99/01 (B1) (GP's 10, 11, 12).

Figure 34:
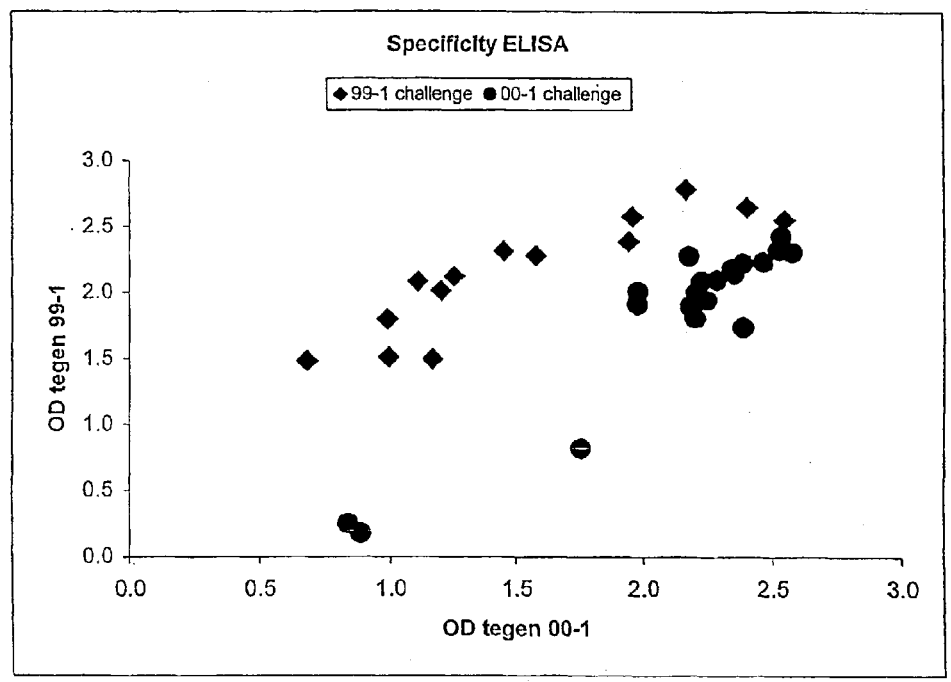

FIG. 34: Specificity of the ned/00/01 (A1) and ned/99/01 (B1) ELISA on sera taken from guinea pigs infected with either ned/00/01 (A1) or ned/99/01 (B1).

Figure 35:
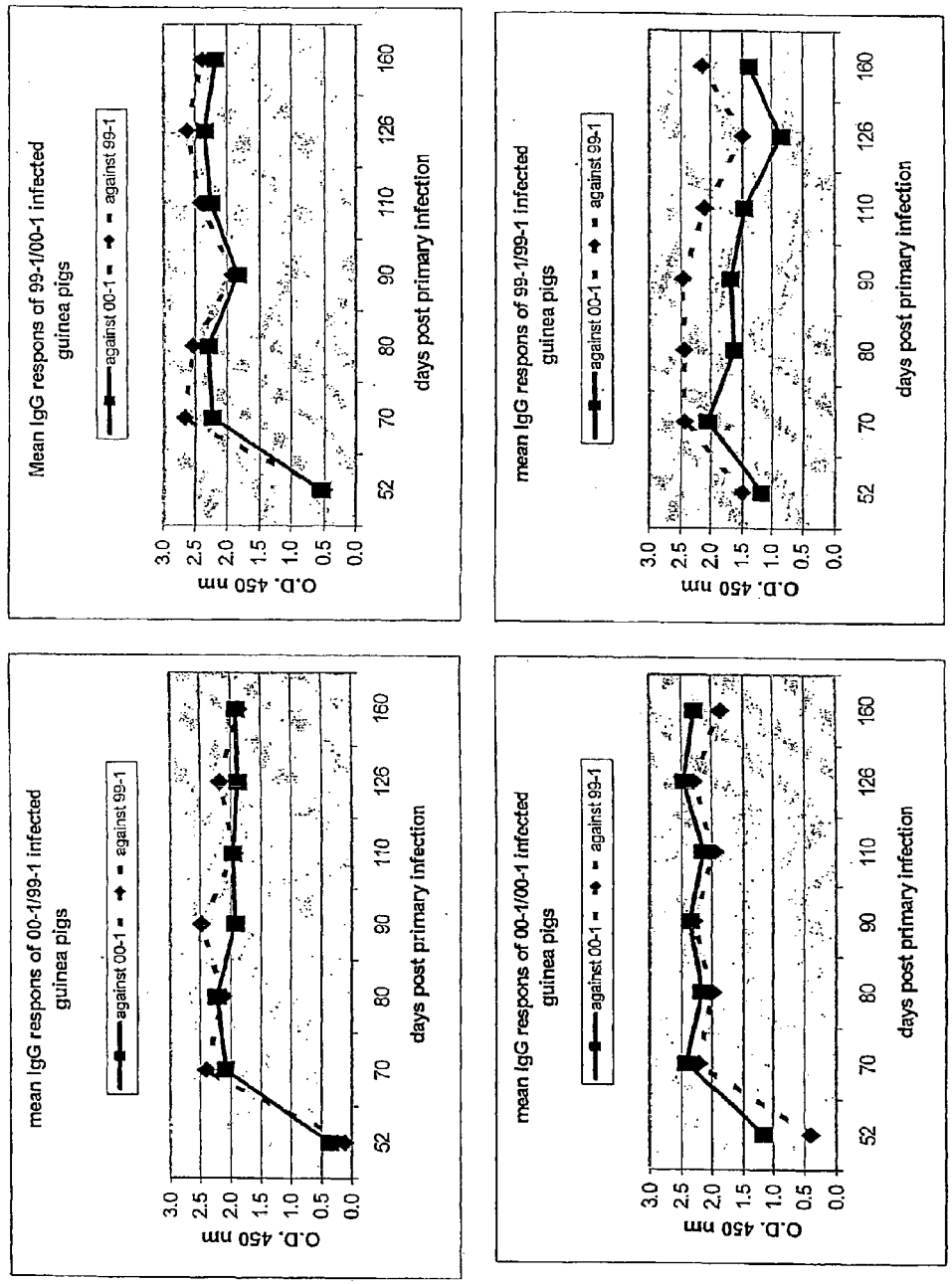

FIG. 35: Mean IgG response against ned/00/01 (A1) and ned/99/01 (B1) ELISA of 3 homologous (00-1/00-1), 2 homologous (99-1/99-1), 2 heterologous (99-1/00-1) heterologous (00-1/99-1) infected guinea pigs.

Figure 36:
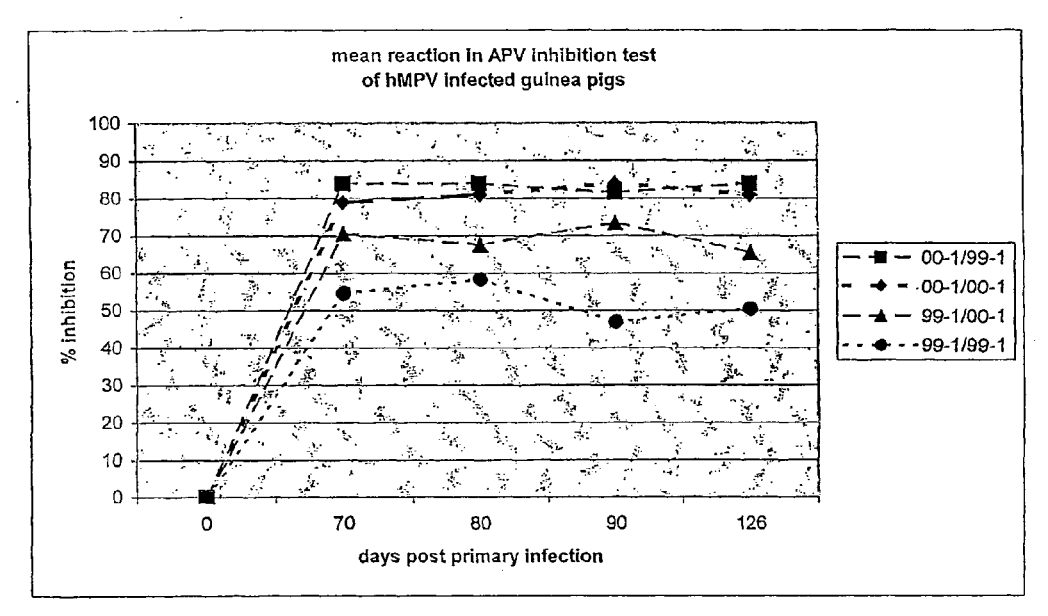

FIG. 36: Mean percentage of APV inhibition of hMPV infected guinea pigs.

FIG. 37: Virus neutralization titers of ned/00/01 (A1) and ned/99/01 (BI) infected guinea pigs against ned/00/01 (A1), ned/99/01 (B1) and APV-C.

FIG. 38: Results of RT-PCR assays on throat swabs of cynomolgous macaques inoculated (twice) with ned/00/01 (A1).

FIG. 39A (top two panels): IgA, IgM and IgG response against ned/00/01 (A1) of 2 cynomologous macaques (re) infected with ned/00/01 (A1).

FIG. 39B (bottom panels): IgG response against APV of 2 Cynomologous macaques infected with ned/00/01 (A1).

Figure 40:
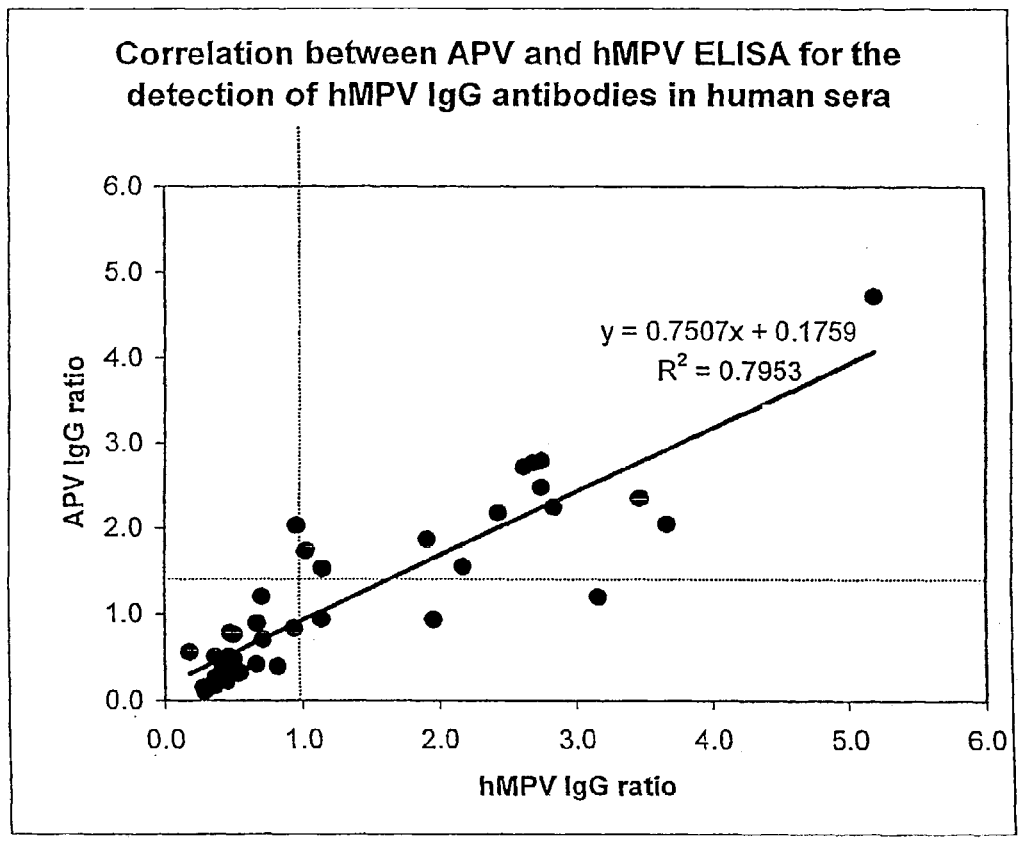

FIG. 40: Comparison of the use of the hMPV ELISA and the APV inhibition ELISA for the detection of IgG antibodies in human sera.

FIG. 41: Comparison of two prototypic hMPV isolates with APV-A and APV-C; DNA similarity matrices for nucleic acids encoding the various viral proteins.

FIG. 42: Comparison of two prototypic hMPV isolates with APV-A and APV-C; protein similarity matrices for the various viral proteins.

FIG. 42b: Comparison of the coding sequences of four prototypes of mammalian MPV. The left column shows nucleic acid sequence comparisons and the right column shows amino acid sequence comparisons. NL/1/00 is the prototype of variant A1 (SEQ ID NO:19). NL/17/00 is the prototype of variant A2 (SEQ ID NO:20). NL/1/99 the prototype of variant B1 (SEQ ID NO:18). NL/1/94 is the prototype of variant B2 (SEQ ID NO:21).

FIG. 43: Amino acid alignment of the nucleoprotein of two prototype hMPV isolates.

FIG. 44: Amino acid alignment of the phosphoprotein of two prototype hMPV isolates.

FIG. 45: Amino acid alignment of the matrix protein of two prototype hMPV isolates.

FIG. 46: Amino acid alignment of the fusion protein of two prototype hMPV isolates.

FIG. 47: Amino acid alignment of the M2-1 protein of two prototype hMPV isolates.

FIG. 48: Amino acid alignment of the M2-2 protein of two prototype hMPV isolates.

FIG. 49: Amino acid alignment of the short hydrophobic protein of two prototype hMPV isolates.

FIG. 50: Amino acid alignment of the attachment glycoprotein of two prototype hMPV isolates.

FIG. 51: Amino acid alignment of the N-terminus of the polymerase protein of two prototype hMPV isolates.

Figure 52:
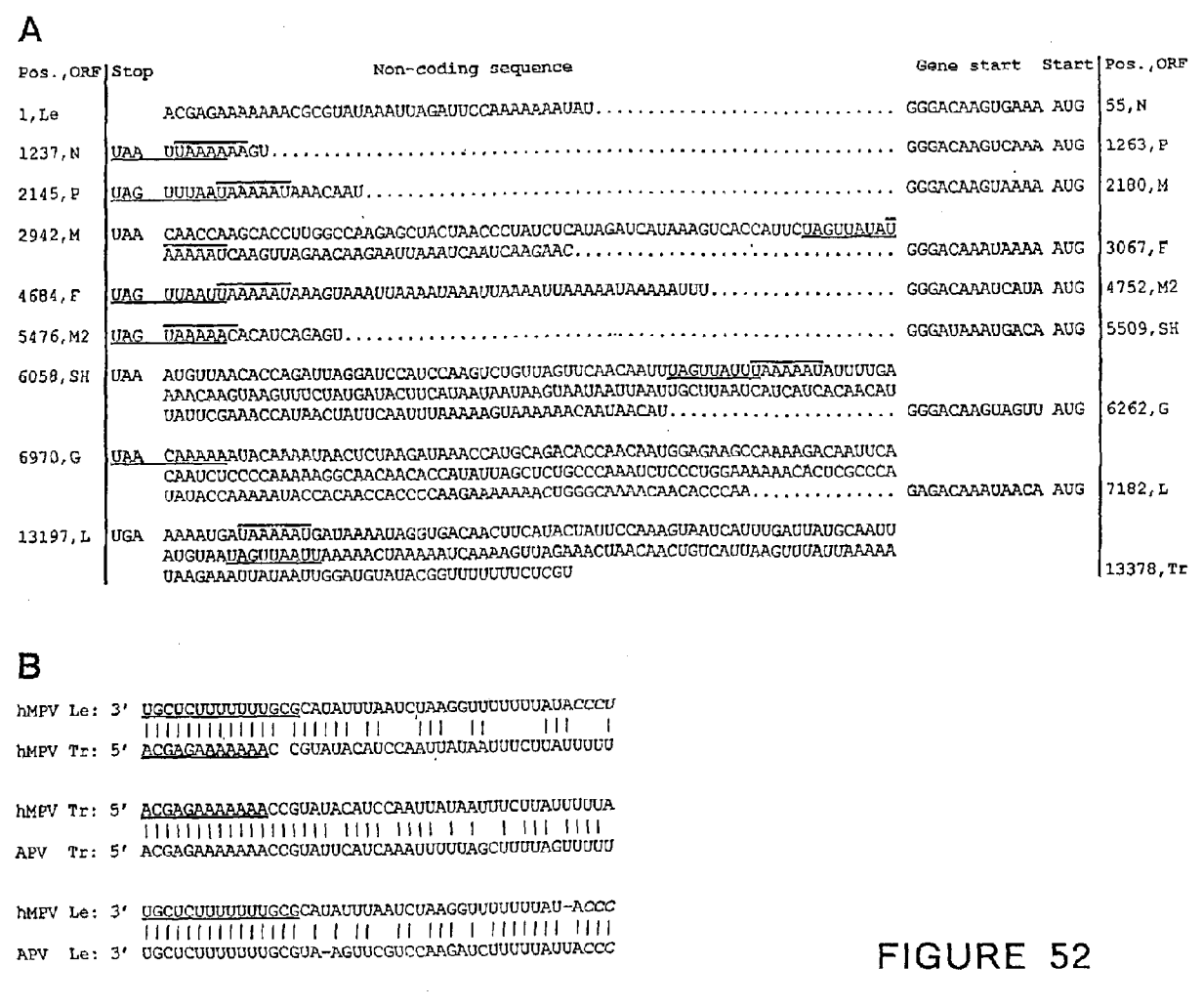

FIG. 52: Noncoding sequences of hMPV isolate 00-1 (A1). (A) The noncoding sequences between the ORFs and at the genomic termini are shown in the positive sense. From left to right, stop codons of indicated ORFs are shown, followed by the noncoding sequences, the gene start signals and start codons of the indicated subsequent ORFs. Numbers indicate the first position of start and stop codons in the hMPV map. Sequences that display similarity to published gene end signals are underlined and sequences that display similarity to UAAAAAU/A/C are represented with a line above the sequence. (B) Nucleotide sequences of the genomic termini of hMPV. The genomic termini of hMPV are aligned with each other and with those of APV. Underlined regions represent the primer sequences used in RT-PCR assays which are based on the 3' and 5' end sequences of APV and RSV. Bold italicized nucleotides are part of the gene start signal of the N gene. Le: leader, Tr: trailer.

Figure 53B:
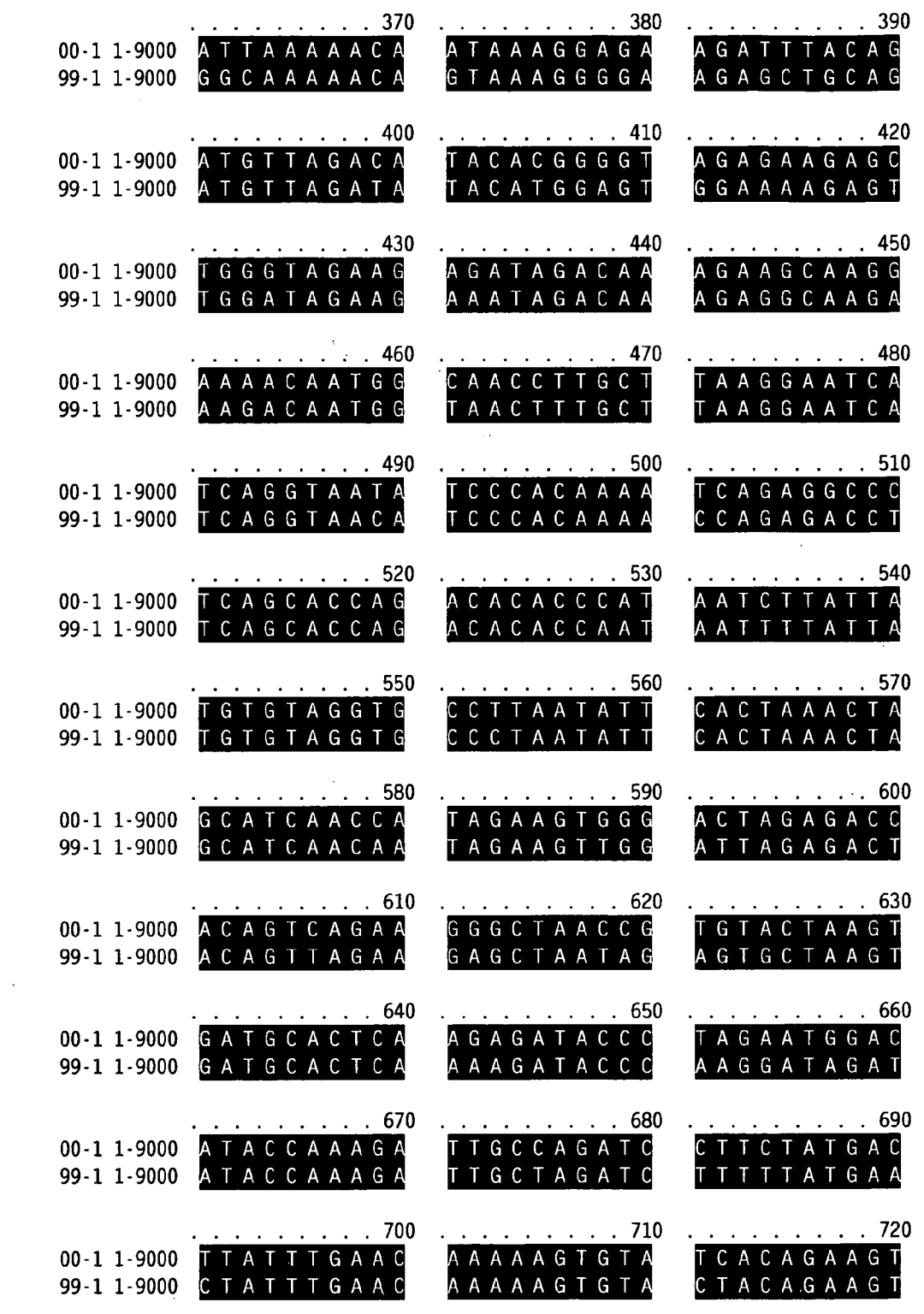
Figure 53D:
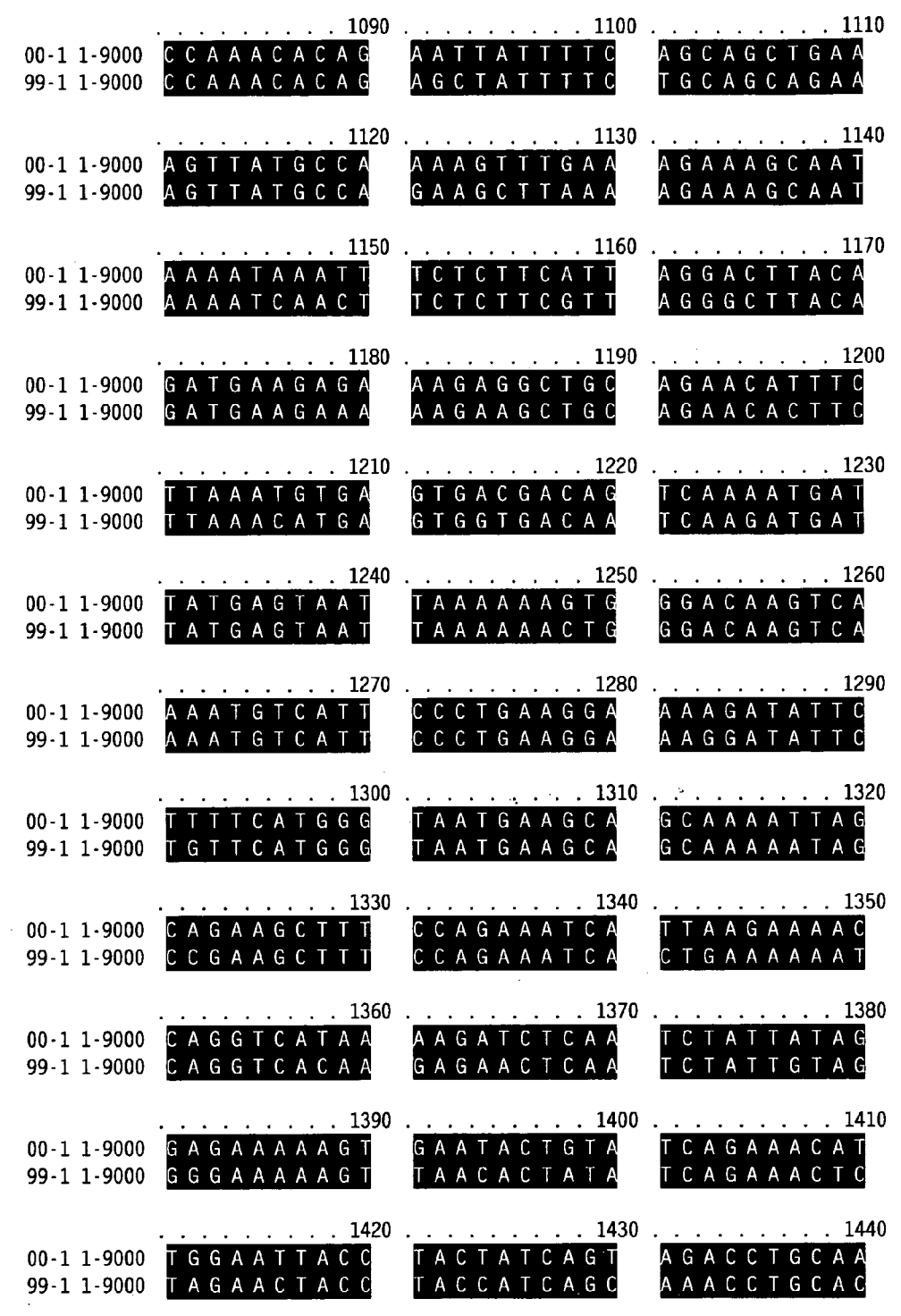
Figure 53J:
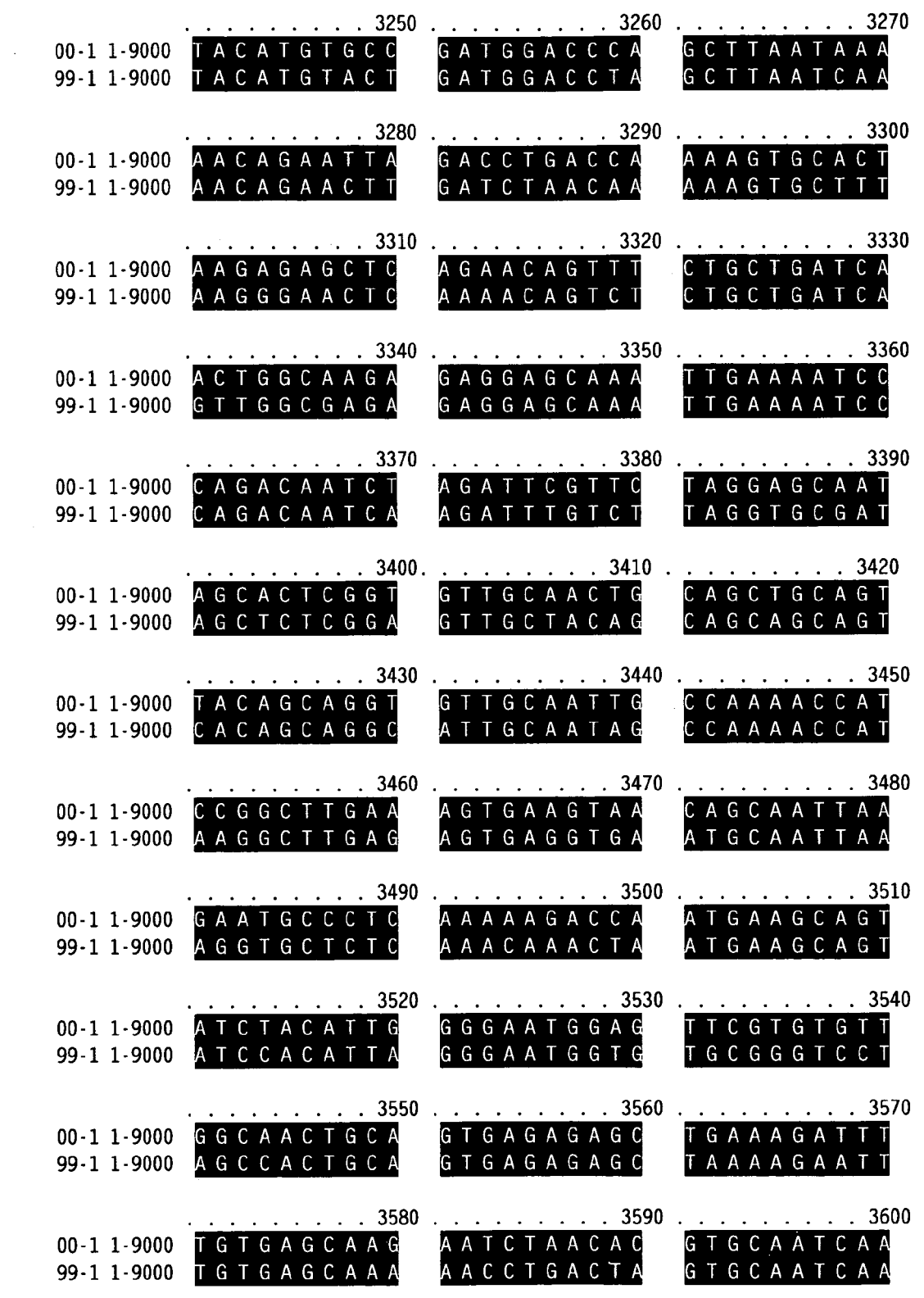
Figure 53P:
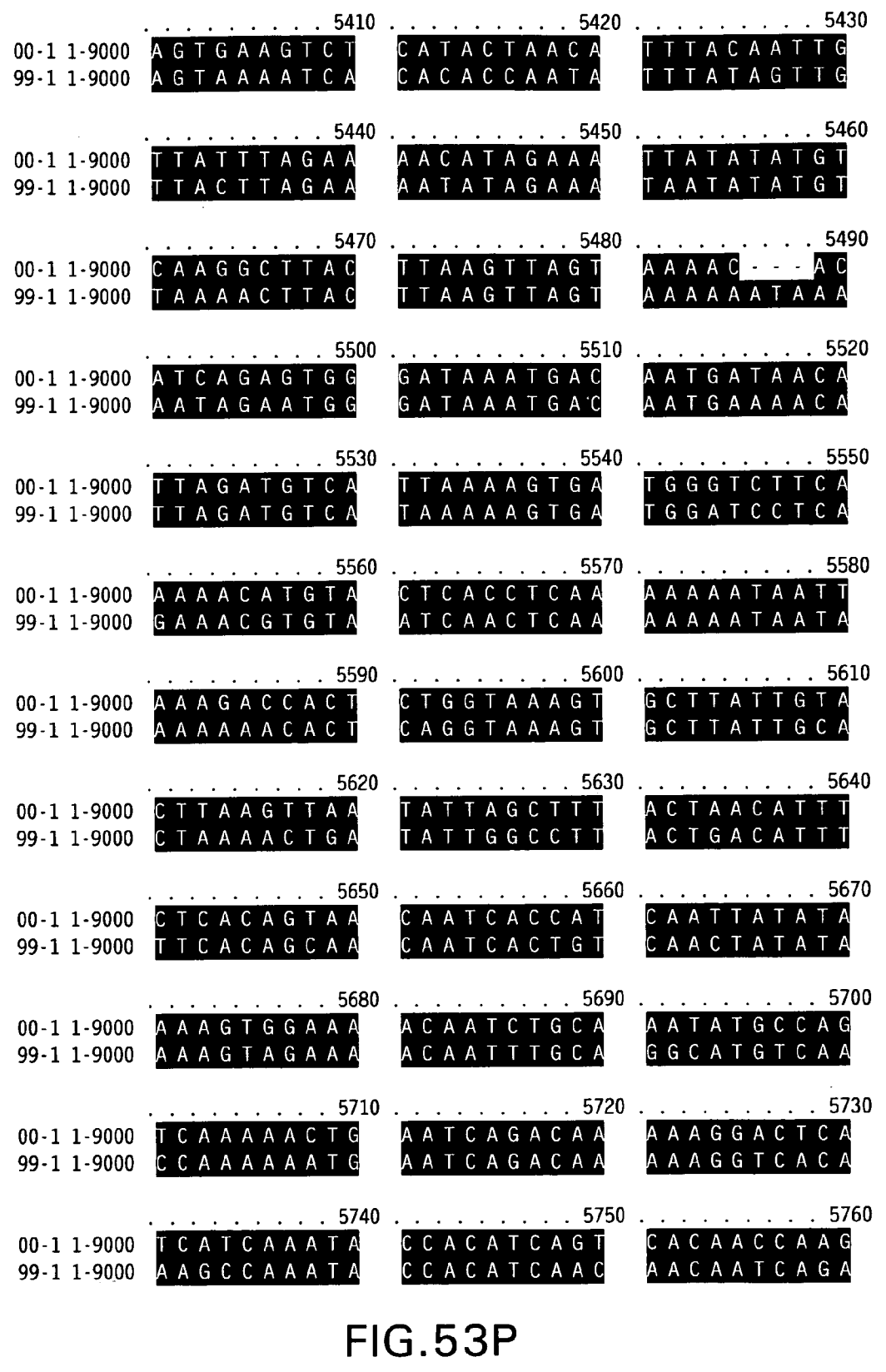
Figure 53R:
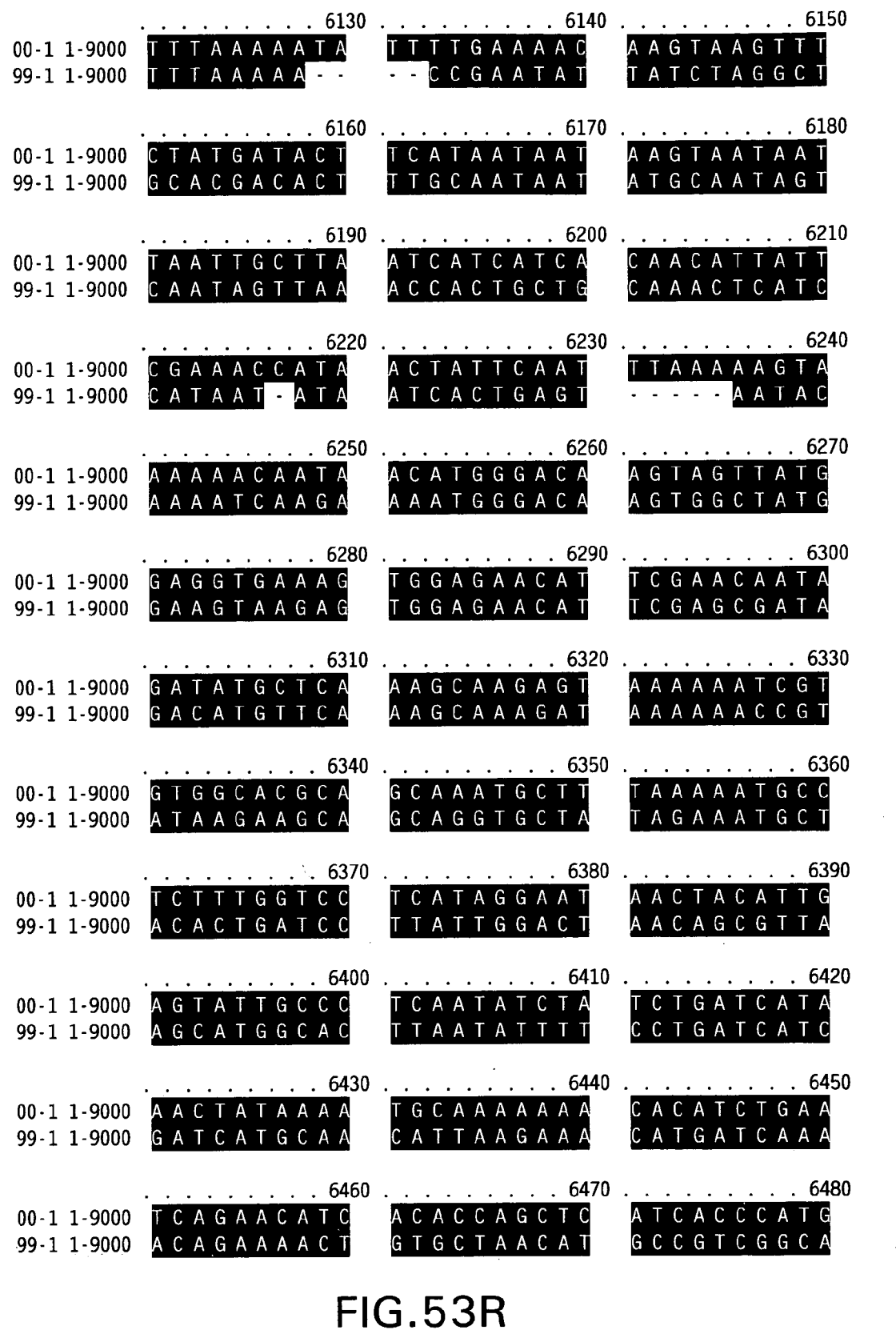
Figure 53S:
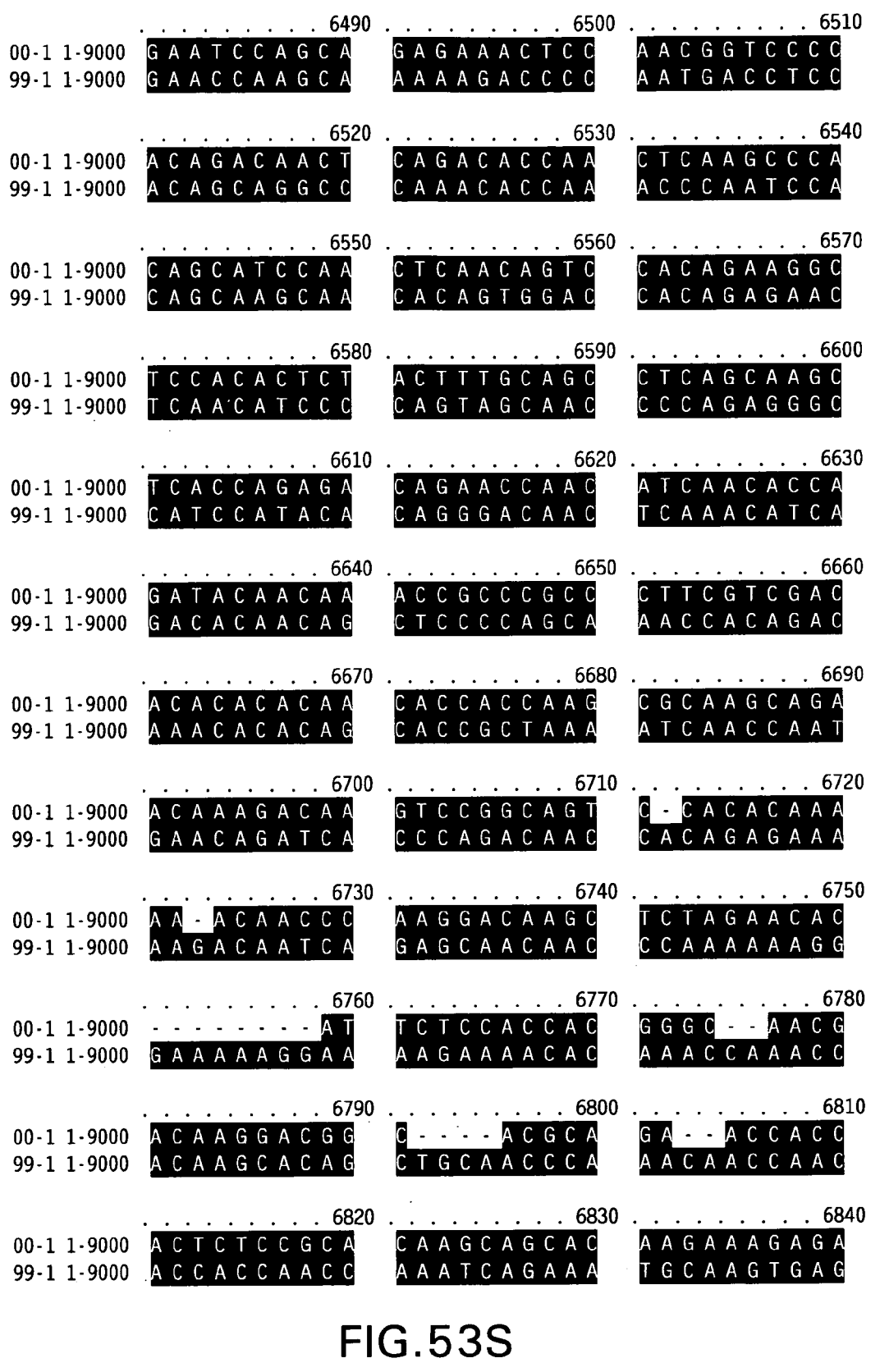
Figure 53T:
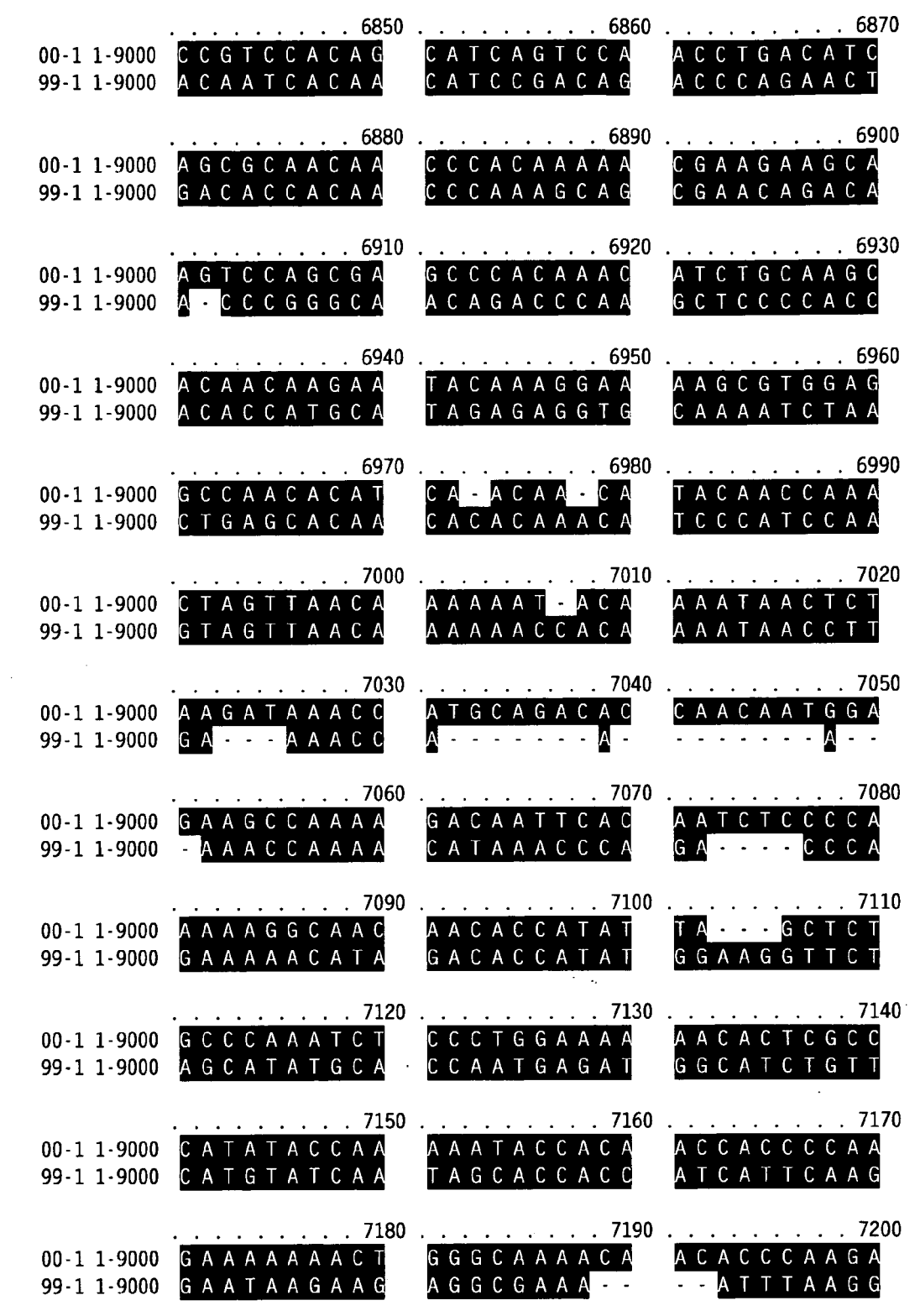
Figure 53W:
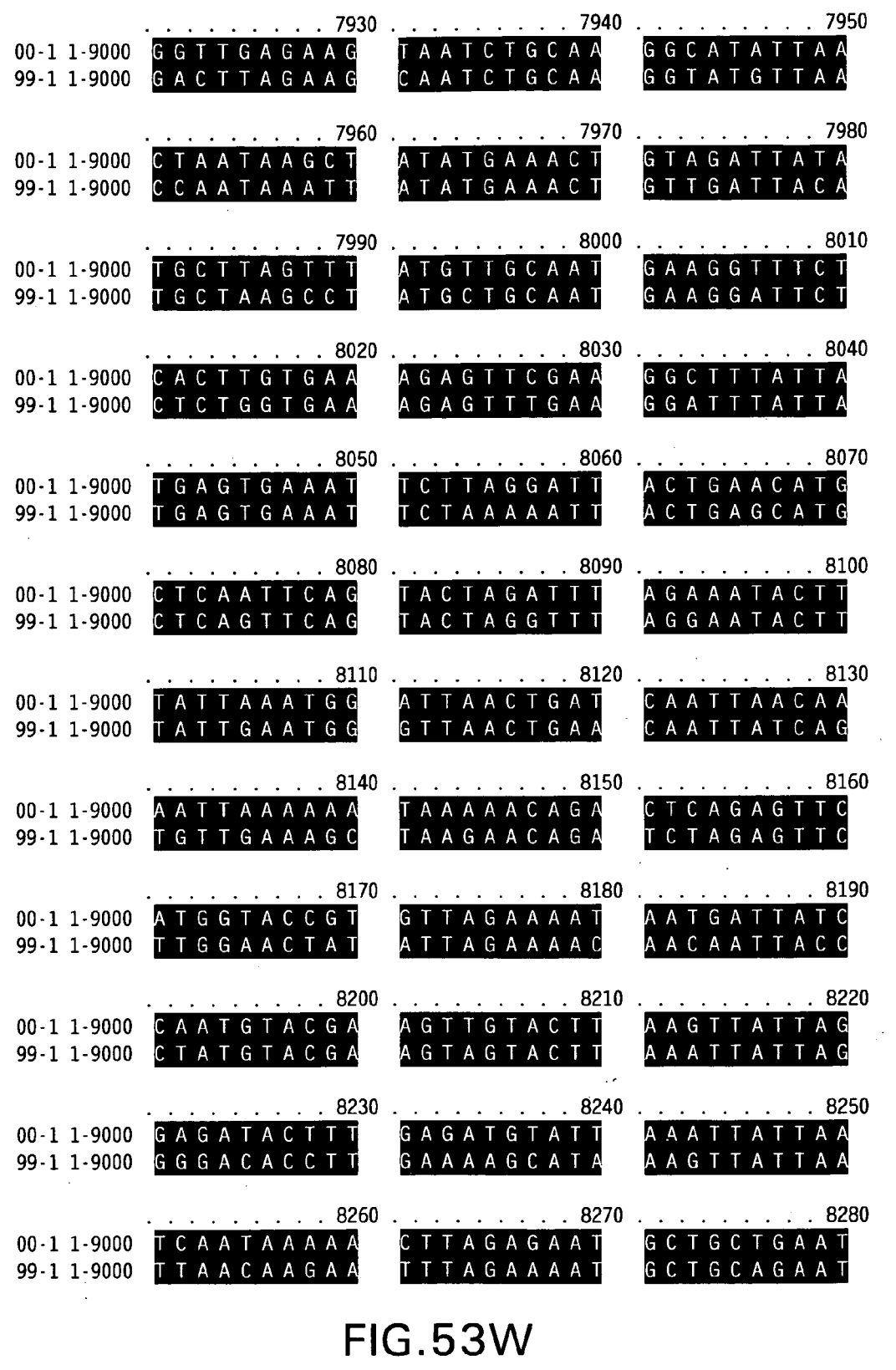
Figure 53X:
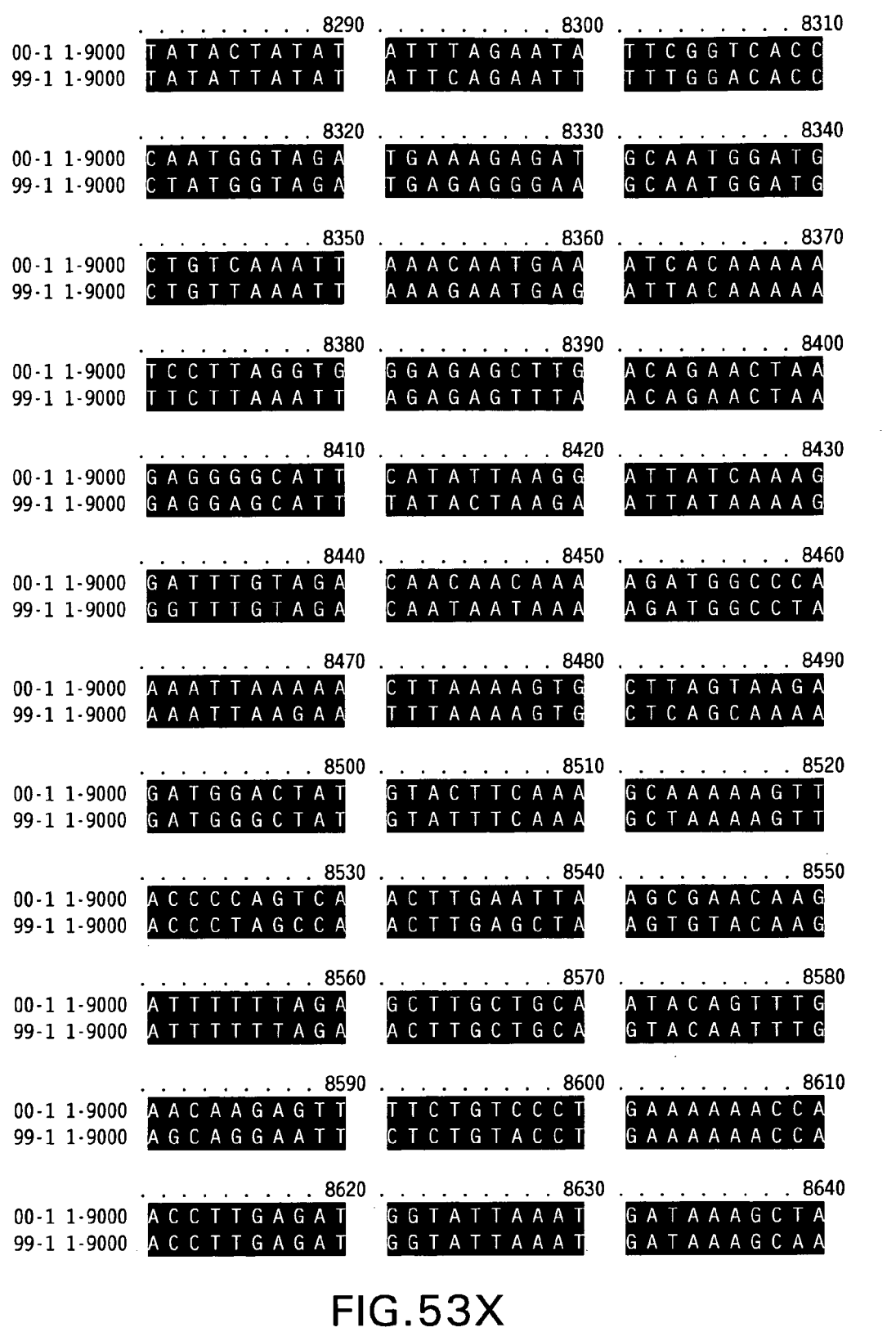
Figure 53Y:
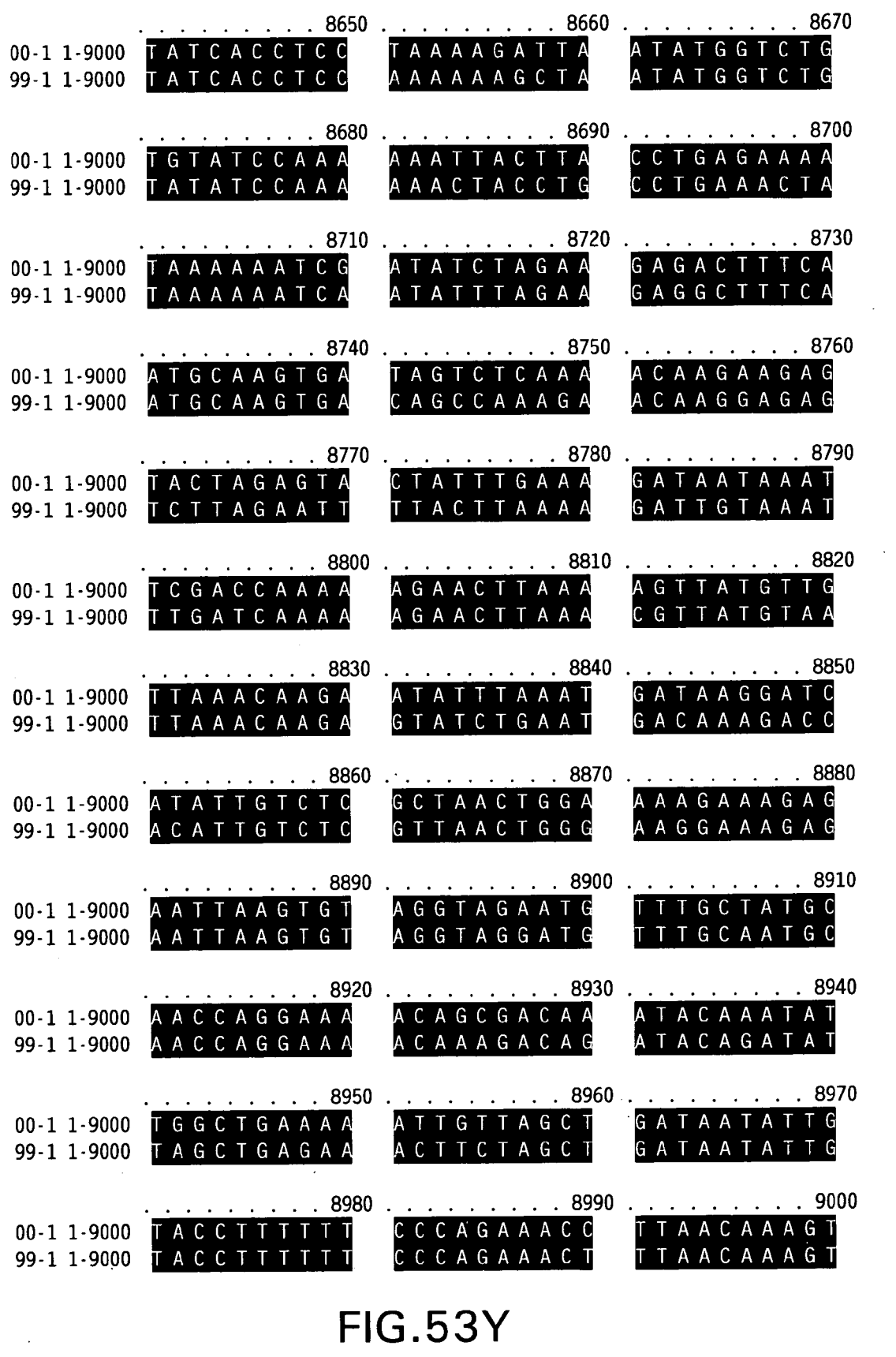
Figure 53Z:
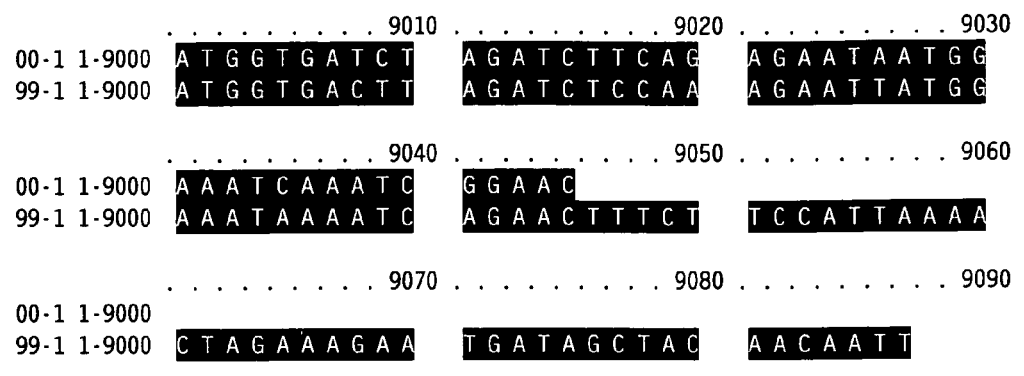

FIG. 53: Sequence comparison of the genomic sequence of hMPV isolate 00-1 (A1) with hMPV isolate 99-1 (B1).

Figure 54:
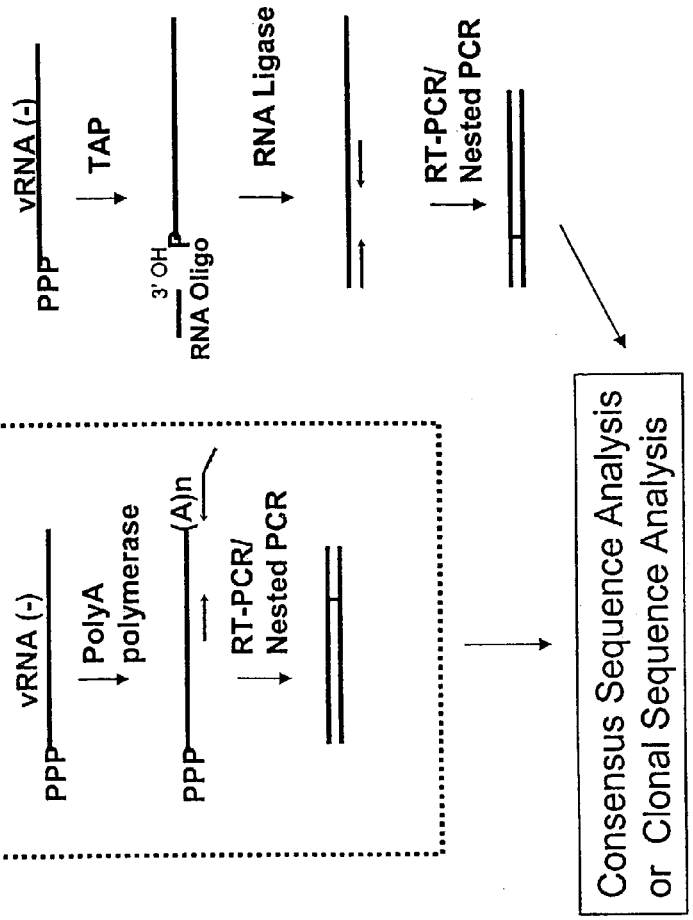

FIG. 54: Leader sequences of human metapneumovirus (hMPV) NL/1/00 (A1) genomic RNA was determined using a combination of polyadenylation and 3' RACE methods.

Figure 55:
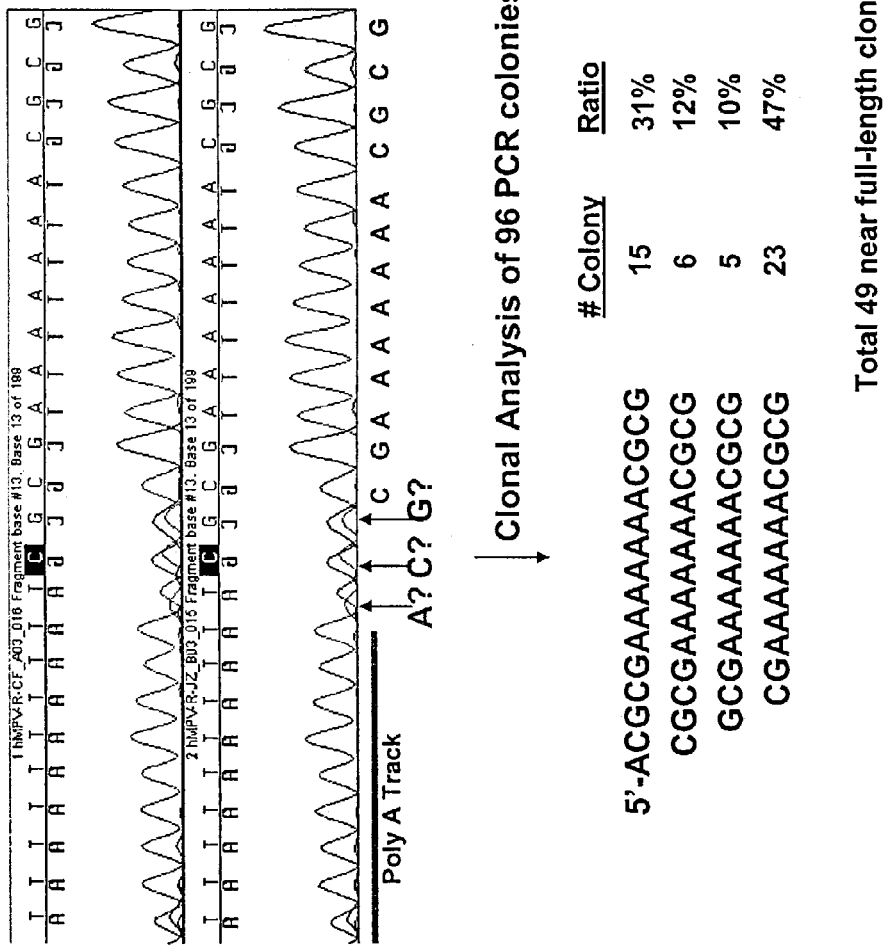

FIG. 55: Sequencing analyses on PCR products directly and on PCR clones both indicated that the leader region of hMPV consisted of 5' ACG CGA AAA AAA CGC GTA TA (expressed as positive sense cDNA orientation) at the 3' most proximal 20 nucleotides in the leader sequence. The two newly identified nucleotides are underlined.

5. DETAILED DESCRIPTION OF THE INVENTION

The invention relates to an isolated mammalian negative strand RNA virus, *metapneumovirus* (MPV) and variants thereof, within the sub-family Pneumovirinae, of the family Paramyxoviridae. The present invention also relates to isolated mammalian negative strand RNA viruses identifiable as phylogenetically corresponding or relating to the genus *metapneumovirus* and components thereof. The mammalian MPVs of the invention can be a variant A1, A2, B1 or B2 mammalian MPV. However, the mammalian MPVs of the present invention may encompass additional variants of MPV yet to be identified, and are not limited to variants A1, A2, B1 or B2.

The invention relates to genomic nucleotide sequences of different variants of isolates of mammalian *metapneumoviruses* (MPV), in particular human *metapneumoviruses* including isolates of variants A1, A2, B1 and B2. The invention relates to the use of the sequence information of different isolates of mammalian *metapneumoviruses* for diagnostic and therapeutic methods. The present invention relates to the differences of the genomic nucleotide sequences among the different *metapneumovirus*-isolates, and their use in the diagnostic and therapeutic methods of the invention. In particular, the invention relates to the use of the single nucleotide polymorphisms (SNPs) among different *metapneumovirus* isolates for diagnostic and therapeutic methods. The present invention also relates to the use serological characterization of the different isolates of mammalian *metapneumoviruses*, alone or in combination with the sequence information of the different isolates, for diagnostic and therapeutic methods.

The present invention relates to nucleotide sequences encoding the genome of a *metapneumovirus* or a portion thereof, including both mammalian and avian *metapneumovirus* (APV). The present invention relates to nucleotide sequences encoding gene products of a *metapneumovirus*, including both mammalian and avian *metapneumoviruses*. The present invention further relates to nucleic acids, including DNA and RNA, that encodes the genome or a portion thereof of a *metapneumovirus*, including both mammalian and avian, in addition to a nucleotide sequence which is heterologous or non-native to the viral genome. The invention further encompasses recombinant or chimeric viruses encoded by said nucleotide sequences.

In accordance with the present invention, a recombinant virus is one derived from a mammalian MPV or an APV that is encoded by endogenous or native genomic sequences or non-native genomic sequences. In accordance with the invention, a non-native sequence is one that is different from the native or endogenous genomic sequence due to one or more mutations, including, but not limited to, point mutations, rearrangements, insertions, deletions etc., the genomic sequence that may or may not result in a phenotypic change. In accordance with the invention, a chimeric virus is a recombinant MPV or APV which further comprises a heterologous nucleotide sequence. In accordance with the invention, a chimeric virus may be encoded by a nucleotide sequence in which heterologous nucleotide sequences have been added to the genome or in which endogenous or native nucleotide sequences have been replaced with heterologous nucleotide sequences.

The invention further relates to vaccine formulations comprising mammalian or avian *metapneumovirus*, including recombinant forms of said viruses. In particular, the present invention encompasses vaccine preparations comprising recombinant or chimeric forms of MPV or APV that express antigenic glycoproteins, including glycoproteins of MPV, or APV and/or non-native MPV or APV glycoproteins. The invention also encompasses vaccine preparations comprising recombinant forms of MPV or APV that encode antigenic sequences of another negative strand RNA virus, including PIV or RSV, or a heterologous glycoprotein of another species or strain of *metapneumovirus*. The invention further relates to vaccines comprising chimeric hMPV wherein the chimeric hMPV encodes one or more APV proteins and wherein the chimeric hMPV optionally additionally expresses one or more heterologous or non-native sequences. The invention also relates to vaccines comprising chimeric APV wherein the chimeric APV encodes one or more hMPV proteins and wherein the chimeric APV optionally additionally expresses one or more heterologous or non-native sequences. The present invention also relates to multivalent vaccines, including bivalent and trivalent vaccines. In particular, the bivalent and trivalent vaccines of the invention encompass two or more antigenic polypeptides expressed by the same or different pneumoviral vectors encoding antigenic proteins of MPV, APV, PIV, RSV, influenza or another negative strand RNA virus, or morbillivirus.

5.1 Mammalian *Metapneumovirus* Structural Characteristics of a Mammalian *Metapneumovirus*

The invention provides a mammalian MPV. The mammalian MPV is a negative-sense single stranded RNA virus belonging to the sub-family Pneumovirinae of the family Paramyxoviridae. Moreover, the mammalian MPV is identifiable as phylogenetically corresponding to the genus *Metapneumovirus*, wherein the mammalian MPV is phylogenetically more closely related to a virus isolate deposited as I-2614 with CNCM, Paris (SEQ ID NO:19) than to turkey rhinotracheitis virus, the etiological agent of avian rhinotracheitis. A virus is identifiable as phylogenetically corresponding to the genus *Metapneumovirus* by, e.g., obtaining nucleic acid sequence information of the virus and testing it in phylogenetic analyses. Any technique known to the skilled artisan can be used to determine phylogenetic relationships between strains of viruses. For exemplary methods see section 5.9. Other techniques are disclosed in International Patent Application PCT/NL02/00040, published as WO 02/057302, which is incorporated by reference in its entirety herein. In particular, PCT/NL02/00040 discloses nucleic acid sequences that are suitable for phylogenetic analysis at page 12, line 27 to page 19, line 29, which are incorporated by reference herein. A virus can further be identified as a mammalian MPV on the basis of sequence similarity as described in more detail below.

In addition to phylogenetic relatedness and sequence similarity of a virus to a mammalian MPV as disclosed herein, the similarity of the genomic organization of a virus to the genomic organization of a mammalian MPV disclosed herein can also be used to identify the virus as a mammalian MPV. For a representative genomic organization of a mammalian MPV see FIG. 27. In certain embodiments, the genomic organization of a mammalian MPV is different from the genomic organization of pneumoviruses within the sub-family Pneumovirinae of the family Paramyxoviridae. The classification of the two genera, metapneumovirus and pneumovirus, is based primarily on their gene constellation; metapneumoviruses generally lack non-structural proteins such as NS1 or NS2 (see also Randhawa et al., 1997, J. Virol. 71:9849-9854) and the gene order is different from that of pneumoviruses (RSV: '3-NS1-NS2-N-P-M-SH-G-F-M2-L-5', APV: '3-N-P-M-F-M2-SH-G-L-5') (Lung, et al., 1992, J. Gen. Virol. 73:1709-1715; Yu, et al., 1992, *Virology* 186:426-434; Randhawa, et al., 1997, J. Virol. 71:9849-9854).

Further, a mammalian MPV of the invention can be identified by its immunological properties. In certain embodiments, specific anti-sera can be raised against mammalian MPV that can neutralize mammalian MPV. Monoclonal and polyclonal antibodies can be raised against MPV that can also neutralize mammalian MPV. (See, PCT WO 02/057302, which is incorporated by reference herein.

The mammalian MPV of the invention is further characterized by its ability to infect a mammalian host, i.e., a mammalian cultured cell or a mammal. Unlike APV, mammalian MPV does not replicate or replicates only at low levels in chickens and turkeys. Mammalian MPV replicates, however, in mammalian hosts, such as cynomolgous macaques. In certain, more specific, embodiments, a mammalian MPV is further characterized by its ability to replicate in a mammalian host. In certain, more specific embodiments, a mammalian MPV is further characterized by its ability to cause the mammalian host to express proteins encoded by the genome of the mammalian MPV. In even more specific embodiments, the viral proteins expressed by the mammalian MPV are inserted into the cytoplasmic membranes of the mammalian host. In certain embodiments, the mammalian MPV of the invention can infect a mammalian host and cause the mammalian host to produce new infectious viral particles of the mammalian MPV. For a more detailed description of the functional characteristics of the mammalian MPV of the invention, see section 5.1.2.

In certain embodiments, the appearance of a virus in an electron microscope or its sensitivity to chloroform can be used to identify the virus as a mammalian MPV. The mammalian MPV of the invention appears in an electron microscope as paramyxovirus-like particle. Consistently, a mammalian MPV is sensitive to treatment with chloroform; a mammalian MPV is cultured optimally on tMK cells or cells functionally equivalent thereto and it is essentially trypsine dependent in most cell cultures. Furthermore, a mammalian MPV has a typical cytopathic effects (CPE) and lacks haemagglutinating activity against species of red blood cells. The CPE induced by MPV isolates are similar to the CPE induced by hRSV, with characteristic syncytia formation followed by rapid internal disruption of the cells and subsequent detachment from the culture plates. Although most paramyxoviruses have haemagglutinating activity, most of the pneumoviruses do not (Pringle, C. R. In: *The Paramyxoviruses*;

(ed. D. W. Kingsbury) 1-39 (Plenum Press, New York, 1991)). A mammalian MPV contains a second overlapping ORF (M2-2) in the nucleic acid fragment encoding the M2 protein. The occurrence of this second overlapping ORF occurs in other pneumoviruses as shown in Ahmadian et al., 1999, *J Gen. Vir.* 80:2011-2016.

In certain embodiments, the invention provides methods to identify a viral isolate as a mammalian MPV. A test sample can, e.g., be obtained from an animal or human. The sample is then tested for the presence of a virus of the sub-family Pneumovirinae. If a virus of the sub-family Pneumovirinae is present, the virus can be tested for any of the characteristics of a mammalian MPV as discussed herein, such as, but not limited to, phylogenetic relatedness to a mammalian MPV, nucleotide sequence identity to a nucleotide sequence of a mammalian MPV, amino acid sequence identity/homology to a amino acid sequence of a mammalian MPV, and genomic organization. Furthermore, the virus can be identified as a mammalian MPV by cross-hybridization experiments using nucleic acid sequences from a MPV isolate, RT-PCR using primers specific to mammalian MPV, or in classical cross-serology experiments using antibodies directed against a mammalian MPV isolate. In certain other embodiments, a mammalian MPV can be identified on the basis of its immunological distinctiveness, as determined by quantitative neutralization with animal antisera. The antisera can be obtained from, e.g., ferrets, pigs or macaques that are infected with a mammalian MPV (see, e.g., Example 8).

In certain embodiments, the serotype does not cross-react with viruses other than mammalian MPV. In other embodiments, the serotype shows a homologous-to-heterologous titer ratio >16 in both directions If neutralization shows a certain degree of cross-reaction between two viruses in either or both directions (homologous-to-heterologous titer ration of eight or sixteen), distinctiveness of serotype is assumed if substantial biophysical/biochemical differences of DNA sequences exist. If neutralization shows a distinct degree of cross-reaction between two viruses in either or both directions (homologous-to-heterologous titer ratio of smaller than eight), identity of serotype of the isolates under study is assumed. Isolate I-2614, herein also known as MPV isolate 00-1, can be used as prototype.

In certain embodiments, a virus can be identified as a mammalian MPV by means of sequence homology/identity of the viral proteins or nucleic acids in comparison with the amino acid sequence and nucleotide sequences of the viral isolates disclosed herein by sequence or deposit. In particular, a virus is identified as a mammalian MPV when the genome of the virus contains a nucleic acid sequence that has a percentage nucleic acid identity to a virus isolate deposited as I-2614 with CNCM, Paris which is higher than the percentages identified herein for the nucleic acids encoding the L protein, the M protein, the N protein, the P protein, or the F protein as identified herein below in comparison with APV-C (see Table 1). (See, PCT WO 02/05302, at pp. 12 to 19, which is incorporated by reference herein. Without being bound by theory, it is generally known that viral species, especially RNA virus species, often constitute a quasi species wherein the members of a cluster of the viruses display sequence heterogeneity. Thus, it is expected that each individual isolate may have a somewhat different percentage of sequence identity when compared to APV-C.

The highest amino sequence identity between the proteins of MPV and any of the known other viruses of the same family to date is the identity between APV-C and human MPV. Between human MPV and APV-C, the amino acid sequence identity for the matrix protein is 87%, 88% for the nucleoprotein, 68% for the phosphoprotein, 81% for the fusion protein and 56-64% for parts of the polymerase protein, as can be deduced when comparing the sequences given in FIG. 30, see also Table 1. Viral isolates that contain ORFs that encode proteins with higher homology compared to these maximum values are considered mammalian MPVs. It should be noted that, similar to other viruses, a certain degree of variation is found between different isolated of mammalian MPVs.

TABLE 1

Amino acid sequence identity between the ORFs of MPV and those of other paramyxoviruses.

|  | N | P | M | F | M2-1 | M2-2 | L |
|---|---|---|---|---|---|---|---|
| APV A | 69 | 55 | 78 | 67 | 72 | 26 | 64 |
| APV B | 69 | 51 | 76 | 67 | 71 | 27 | —[2] |
| APV C | 88 | 68 | 87 | 81 | 84 | 56 | —[2] |
| hRSV A | 42 | 24 | 38 | 34 | 36 | 18 | 42 |
| hRSV B | 41 | 23 | 37 | 33 | 35 | 19 | 44 |
| bRSV | 42 | 22 | 38 | 34 | 35 | 13 | 44 |
| PVM | 45 | 26 | 37 | 39 | 33 | 12 | —[2] |
| others[3] | 7-11 | 4-9 | 7-10 | 10-18 | —[4] | —[4] | 13-14 |

Footnotes:
[1]No sequence homologies were found with known G and SH proteins and were thus excluded
[2]Sequences not available.
[3]others: human parainfluenza virus type 2 and 3, Sendai virus, measles virus, nipah virus, phocine distemper virus, and New Castle Disease virus.
[4]ORF absent in viral genome.

In certain embodiments, the inventio provides a mammalian MPV, wherein the amino acid sequence of the SH protein of the mammalian MPV is at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or at least 99.5% identical to the amino acid sequence of SEQ ID NO:382 (SH protein of isolate NL/1/00; see Table 14). The isolated negative-sense single stranded RNA *metapneumovirus* that comprises the SH protein that is at least 30% identical to SEQ ID NO:382 (SH protein of isolate NL/1/00; see Table 14) is capable of infecting a mammalian host. In certain embodiments, the isolated negative-sense single stranded RNA *metapneumovirus* that comprises the SH protein that is at least 30% identical to SEQ ID NO:382 (SH protein of isolate NL/1/00; see Table 14) is capable of replicating in a mammalian host. In certain embodiments, a mammalian MPV contains a nucleotide sequence that encodes a SH protein that is at least 30% identical to SEQ ID NO:382 (SH protein of isolate NL/1/00; see Table 14).

In certain embodiments, the invention provides a mammalian MPV, wherein the amino acid sequence of the G protein of the mammalian MPV is at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, at least 98%, at least 99%, or at least 99.5% identical to the amino acid sequence of SEQ ID NO:322 (G protein of isolate NL/1/00; see Table 14). The isolated negative-sense single stranded RNA metapneumovirus that comprises the G protein that is at least 20% identical to SEQ ID NO:322 (G protein of isolate NL/1/00; see Table 14) is capable of infecting a mammalian host. In certain embodiments, the isolated negative-sense single stranded RNA *metapneumovirus* that comprises the G protein that is at least 20% identical to SEQ ID NO:322 (G protein of isolate NL/1/00; see Table 14) is capable of replicating in a mammalian host. In certain embodiments, a mammalian MPV contains a nucleotide sequence that encodes a G protein that is at least 20% identical to SEQ ID NO:322 (G protein of isolate NL/1/00; see Table 14).

In certain embodiments, the invention provides a mammalian MPV, wherein the amino acid sequence of the L protein of the mammalian MPV is at least 85%, at least 90%, at least 95%, at least 98%, at least 99%, or at least 99.5% identical to the amino acid sequence of SEQ ID NO:330 (L protein of isolate NL/1/00; see Table 14). The isolated negative-sense single stranded RNA *metapneumovirus* that comprises the L protein that is at least 85% identical to SEQ ID NO:330 (L protein of isolate NL/1/00; see Table 14) is capable of infecting a mammalian host. In certain embodiments, the isolated negative-sense single stranded RNA metapneumovirus that comprises the L protein that is at least 85% identical to SEQ ID NO:330 (L protein of isolate NL/1/00; see Table 14) is capable of replicating in a mammalian host. In certain embodiments, a mammalian MPV contains a nucleotide sequence that encodes a L protein that is at least 20% identical to SEQ ID NO:330 (L protein of isolate NL/1/00; see Table 14).

In certain embodiments, the invention provides a mammalian MPV, wherein the amino acid sequence of the N protein of the mammalian MPV is at least 90%, at least 95%, or at least 98% identical to the amino acid sequence of SEQ ID NO:366. The isolated negative-sense single stranded RNA *metapneumovirus* that comprises the N protein that is at least 90% identical in amino acid sequence to SEQ ID NO:366 is capable of infecting mammalian host. In certain embodiments, the isolated negative-sense single stranded RNA metapneumovirus that comprises the N protein that is 90% identical in amino acid sequence to SEQ ID NO:366 is capable of replicating in a mammalian host. The amino acid identity is calculated over the entire length of the N protein. In certain embodiments, a mammalian MPV contains a nucleotide sequence that encodes a N protein that is at least 90%, at least 95%, or at least 98% identical to the amino acid sequence of SEQ ID NO:366.

The invention further provides mammalian MPV, wherein the amino acid sequence of the P protein of the mammalian MPV is at least 70%, at least 80%, at least 90%, at least 95% or at least 98% identical to the amino acid sequence of SEQ ID NO:374. The mammalian MPV that comprises the P protein that is at least 70% identical in amino acid sequence to SEQ ID NO:374 is capable of infecting a mammalian host. In certain embodiments, the mammalian MPV that comprises the P protein that is at least 70% identical in amino acid sequence to SEQ ID NO:374 is capable of replicating in a mammalian host. The amino acid identity is calculated over the entire length of the P protein. In certain embodiments, a mammalian MPV contains a nucleotide sequence that encodes a P protein that is at least 70%, at least 80%, at least 90%, at least 95% or at least 98% identical to the amino acid sequence of SEQ ID NO:374.

The invention further provides, mammalian MPV, wherein the amino acid sequence of the M protein of the mammalian MPV is at least 90%, at least 95% or at least 98% identical to the amino acid sequence of SEQ ID NO:358. The mammalian MPV that comprises the M protein that is at least 90% identical in amino acid sequence to SEQ ID NO:358 is capable of infecting mammalian host. In certain embodiments, the isolated negative-sense single stranded RNA *metapneumovirus* that comprises the M protein that is 90% identical in amino acid sequence to SEQ ID NO:358 is capable of replicating in a mammalian host. The amino acid identity is calculated over the entire length of the M protein. In certain embodiments, a mammalian MPV contains a nucleotide sequence that encodes a M protein that is at least 90%, at least 95% or at least 98% identical to the amino acid sequence of SEQ ID NO:358.

The invention further provides mammalian MPV, wherein the amino acid sequence of the F protein of the mammalian MPV is at least 85%, at least 90%, at least 95% or at least 98% identical to the amino acid sequence of SEQ ID NO:314. The mammalian MPV that comprises the F protein that is at least 85% identical in amino acid sequence to SEQ ID NO:314 is capable of infecting a mammalian host. In certain embodiments, the isolated negative-sense single stranded RNA metapneumovirus that comprises the F protein that is 85% identical in amino acid sequence to SEQ If) NO:314 is capable of replicating in mammalian host. The amino acid identity is calculated over the entire length of the F protein. In certain embodiments, a mammalian MPV contains a nucleotide sequence that encodes a F protein that is at least 85%, at least 90%, at least 95% or at least 98% identical to the amino acid sequence of SEQ ID NO:314.

The invention further provides mammalian MPV, wherein the amino acid sequence of the M2-1 protein of the mammalian MPV is at least 85%, at least 90%, at least 95% or at least 98% identical to the amino acid sequence of SEQ ID NO:338. The mammalian MPV that comprises the M2-1 protein that is at least 85% identical in amino acid sequence to SEQ ID NO:338 is capable of infecting a mammalian host. In certain embodiments, the isolated negative-sense single stranded RNA metapneumovirus that comprises the M2-1 protein that is 85% identical in amino acid sequence to SEQ ID NO:338 is capable of replicating in a mammalian host. The amino acid identity is calculated over the entire length of the M2-1 protein. In certain embodiments, a mammalian MPV contains a nucleotide sequence that encodes a M2-1 protein that is at least 85%, at least 90%, at least 95% or at least 98% identical to the amino acid sequence of SEQ ID NO:338.

The invention further provides mammalian MPV, wherein the amino acid sequence of the M2-2 protein of the mammalian MPV is at least 60%, at least 70%, at least 80%, at least 90%, at least 95% or at least 98% identical to the amino acid sequence of SEQ ID NO:346 The isolated mammalian MPV that comprises the M2-2 protein that is at least 60% identical in amino acid sequence to SEQ ID NO:346 is capable of infecting mammalian host. In certain embodiments, the isolated negative-sense single stranded RNA metapneumovirus that comprises the M2-2 protein that is 60% identical in amino acid sequence to SEQ ID NO:346 is capable of replicating in a mammalian host. The amino acid identity is calculated over the entire length of the M2-2 protein. In certain embodiments, a mammalian MPV contains a nucleotide sequence that encodes a M2-1 protein that is is at least 60%, at least 70%, at least 80%, at least 90%, at least 95% or at least 98% identical to the amino acid sequence of SEQ ID NO:346.

In certain embodiments, the invention provides mammalian MPV, wherein the negative-sense single stranded RNA metapneumovirus encodes at least two proteins, at least three proteins, at least four proteins, at least five proteins, or six proteins selected from the group consisting of (i) a N protein with at least 90% amino acid sequence identity to SEQ ID NO:366; (ii) a P protein with at least 70% amino acid sequence identity to SEQ ID NO:374 (iii) a M protein with at least 90% amino acid sequence identity to SEQ ID NO:358 (iv) a F protein with at least 85% amino acid sequence identity to SEQ ID NO:314 (v) a M2-1 protein with at least 85% amino acid sequence identity to SEQ ID NO:338; and (vi) a M2-2 protein with at least 60% amino acid sequence identity to SEQ ID NO:346.

The invention provides two subgroups of mammalian MPV, subgroup A and subgroup B. The invention also provides four variants A1, A2, B1 and B2. A mammalian MPV can be identified as a member of subgroup A if it is phylogenetically closer related to the isolate 00-1 (SEQ ID NO:19) than to the isolate 99-1 (SEQ ID NO:18). A mammalian MPV can be identified as a member of subgroup B if it is phylogenetically closer related to the isolate 99-1 (SEQ ID NO:18) than to the isolate 00-1 (SEQ ID NO:19). In other embodiments, nucleotide or amino acid sequence homologies of individual ORFs can be used to classify a mammalian MPV as belonging to subgroup A or B.

The different isolates of mammalian MPV can be divided into four different variants, variant A1, variant A2, variant B1 and variant B2 (see FIGS. 21 and 22). The isolate 00-1 (SEQ ID NO:19) is an example of the variant A1 of mammalian MPV. The isolate 99-1 (SEQ ID NO:18) is an example of the variant B1 of mammalian MPV. A mammalian MPV can be grouped into one of the four variants using a phylogenetic analysis. Thus, a mammalian MPV belongs to a specific variant if it is phylogenetically closer related to a known member of that variant than it is phylogenetically related to a member of another variant of mammalian MPV. The sequence of any ORF and the encoded polypeptide may be used to type a MPV isolate as belonging to a particular subgroup or variant, including N, P, L, M, SH, G, M2 or F polypeptides. In a specific embodiment, the classification of a mammalian MPV into a variant is based on the sequence of the G protein. Without being bound by theory, the G protein sequence is well suited for phylogenetic analysis because of the high degree of variation among G proteins of the different variants of mammalian MPV.

In certain embodiments of the invention, sequence homology may be determined by the ability of two sequences to hybridize under certain conditions, as set forth below. A nucleic acid which is hybridizable to a nucleic acid of a mammalian MPV, or to its reverse complement, or to its complement can be used in the methods of the invention to determine their sequence homology and identities to each other. In certain embodiments, the nucleic acids are hybridized under conditions of high stringency.

It is well-known to the skilled artisan that hybridization conditions, such as, but not limited to, temperature, salt concentration, pH, formamide concentration (see, e.g., Sambrook et al., 1989, Chapters 9 to 11, Molecular Cloning, A Laboratory Manual, 2d Ed., Cold Spring Harbor Laboratory Press, Cold Spring Harbor, N.Y., incorporated herein by reference in its entirety). In certain embodiments, hybridization is performed in aqueous solution and the ionic strength of the solution is kept constant while the hybridization temperature is varied dependent on the degree of sequence homology between the sequences that are to be hybridized. For DNA sequences that 100% identical to each other and are longer than 200 basebairs, hybridization is carried out at approximately 15-25° C. below the melting temperature (Tm) of the perfect hybrid. The melting temperature (Tm) can be calculated using the following equation (Bolton and McCarthy, 1962, Proc. Natl. Acad. Sci. USA 84:1390):

$$Tm = 81.5° C. - 16.6(\log 10[Na+]) + (\% \ G+C) - 0.63(\% \ \text{formamide}) - (600/1)$$

Wherein (Tm) is the melting temperature, [Na+] is the sodium concentration, G+C is the Guanine and Cytosine content, and I is the length of the hybrid in basepairs. The effect of mismatches between the sequences can be calculated using the formula by Bonner et al. (Bonner et al., 1973, J. Mol. Biol.

81:123-135): for every 1% of mismatching of bases in the hybrid, the melting temperature is reduced by 1-1.5° C.

Thus, by determining the temperature at which two sequences hybridize, one of skill in the art can estimate how similar a sequence is to a known sequence. This can be done, e.g., by comparison of the empirically determined hybridization temperature with the hybridization temperature calculated for the know sequence to hybridize with its perfect match. Through the use of the formula by Bonner et al., the relationship between hybridization temperature and percent mismatch can be exploited to provide information about sequence similarity.

By way of example and not limitation, procedures using such conditions of high stringency are as follows. Prehybridization of filters containing DNA is carried out for 8 h to overnight at 65 C in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65 C in prehybridization mixture containing 100 µg/ml denatured salmon sperm DNA and 5-20×106 cpm of 32P-labeled probe. Washing of filters is done at 37 C for 1 h in a solution containing 2×SSC, 0.01% PVP, 0.01% Ficoll, and 0.01% BSA. This is followed by a wash in 0.1×SSC at 50 C for 45 min before autoradiography. Other conditions of high stringency which may be used are well known in the art. In other embodiments of the invention, hybridization is performed under moderate of low stringency conditions, such conditions are well-known to the skilled artisan (see e.g., Sambrook et al., 1989, Molecular Cloning, A Laboratory Manual, 2d Ed., Cold Spring Harbor Laboratory Press, Cold Spring Harbor, N.Y.; see also, Ausubel et al., eds., in the Current Protocols in Molecular Biology series of laboratory technique manuals, 1987-1997 Current Protocols,© 1994-1997 John Wiley and Sons, Inc., each of which is incorporated by reference herein in their entirety). An illustrative low stringency condition is provided by the following system of buffers: hybridization in a buffer comprising 35% formamide, 5×SSC, 50 mM Tris-HCl (pH 7.5), 5 mM EDTA, 0.02% PVP, 0.02% Ficoll, 0.2% BSA, 100 µg/ml denatured salmon sperm DNA, and 10% (wt/vol) dextran sulfate for 18-20 hours at 40° C., washing in a buffer consisting of 2×SSC, 25 mM Tris-HCl (pH 7.4), 5 mM EDTA, and 0.1% SDS for 1.5 hours at 55° C., and washing in a buffer consisting of 2×SSC, 25 mM Tris-HCl (pH 7.4), 5 mM EDTA, and 0.1% SDS for 1.5 hours at 60° C.

In certain embodiments, a mammalian MPV can be classified into one of the variant using probes that are specific for a specific variant of mammalian MPV. Such probes include primers for RT-PCR and antibodies. Illustrative methods for identifying a mammalian MPV as a member of a specific variant are described in section 5.9 below.

In certain embodiments of the invention, the different variants of mammalian MPV can be distinguished from each other by way of the amino acid sequences of the different viral proteins (see, e.g., FIG. 42b). In other embodiments, the different variants of mammalian MPV can be distinguished from each other by way of the nucleotide sequences of the different ORFs encoded by the viral genome (see, e.g., FIG. 42b). A variant of mammalian MPV can be, but is not limited to, A1, A2, B1 or B2. The invention, however, also contemplates isolates of mammalian MPV that are members of another variant yet to be identified. The invention also contemplates that a virus may have one or more ORF that is closer related to one variant and one or more ORFs that are closer phylogenetically related to another variant. Such a virus would be classified into the variant to which the majority of its ORFs are closer phylogenetically related. Non-coding sequences may also be used to determine phylogenetic relatedness.

An isolate of mammalian MPV is classified as a variant B1 if it is phylogenetically closer related to the viral isolate NL/1/99 (SEQ ID NO:18) than it is related to any of the following other viral isolates: NL/1/00 (SEQ ID NO:19), NL/17/00 (SEQ ID NO:20) and NL/1/94 (SEQ ID NO:21). One or more of the ORFs of a mammalian MPV can be used to classify the mammalian MPV into a variant. A mammalian MPV can be classified as an MPV variant B1, if the amino acid sequence of its G protein is at least 66%, at least 70%, at least 75%, at least 80%, at least 85%, at least 90%, at least 95%, at least 98%, or at least 99% or at least 99.5% identical to the G protein of a mammalian MPV variant B1 as represented by the prototype NL/1/99 (SEQ ID NO:324); if the amino acid sequence of its N proteint is at least 98.5% or at least 99% or at least 99.5% identical to the N protein of a mammalian MPV variant B1 as represented by the prototype NL/1/99 (SEQ ID NO:368); if the amino acid sequence of its P protein is at least 96%, at least 98%, or at least 99% or at least 99.5% identical to the P protein of a mammalian MPV variant B1 as represented by the prototype NL/1/99 (SEQ ID NO:376); if the amino acid sequence of its M protein is identical to the M protein of a mammalian MPV variant B1 as represented by the prototype NL/1/99 (SEQ ID NO:360); if the amino acid sequence of its F protein is at least 99% identical to the F protein of a mammalian MPV variant B1 as represented by the prototype NL/1/99 (SEQ ID NO:316); if the amino acid sequence of its M2-1 protein is at least 98% or at least 99% or at least 99.5% identical to the M2-1 protein of a mammalian MPV variant B1 as represented by the prototype NL/1/99 (SEQ ID NO:340); if the amino acid sequence of its M2-2 protein is at least 99% or at least 99.5% identical to the M2-2 protein of a mammalian MPV variant B1 as represented by the prototype NL/1/99 (SEQ ID NO:348); if the amino acid sequence of its SH protein is at least 83%, at least 85%, at least 90%, at least 95%, at least 98%, or at least 99% or at least 99.5% identical to the SH protein of a mammalian MPV variant B1 as represented by the prototype NL/1/99 (SEQ ID NO:384); and/or if the amino acid sequence of its L protein is at least 99% or at least 99.5% identical to the L protein a mammalian MPV variant B1 as represented by the prototype NL/1/99 (SEQ ID NO:332).

An isolate of mammalian MPV is classified as a variant A1 if it is phylogenctically closer related to the viral isolate NL/1/00 (SEQ ID NO:19) than it is related to any of the following other viral isolates: NL/1/99 (SEQ ID NO:18), NL/17/00 (SEQ ID NO:20) and NL/1/94 (SEQ ID NO:21). One or more of the ORFs of a mammalian MPV can be used to classify the mammalian MPV into a variant. A mammalian MPV can be classified as an MPV variant A1, if the amino acid sequence of its G protein is at least 66%, at least 70%, at least 75%, at least 80%, at least 85%, at least 90%, at least 95%, at least 98%, or at least 99% or at least 99.5% identical to the G protein of a mammalian MPV variant A1 as represented by the prototype NL/1/00 (SEQ ID NO:322); if the amino acid sequence of its N protein is at least 99.5% identical to the N protein of a mammalian MPV variant A1 as represented by the prototype NL/1/00 (SEQ ID NO:366); if the amino acid sequence of its P protein is at least 96%, at least 98%, or at least 99% or at least 99.5% identical to the P protein of a mammalian MPV variant A1 as represented by the prototype NL/1/00 (SEQ ID NO:374); if the amino acid sequence of its M protein is at least 99% or at least 99.5% identical to the M protein of a mammalian MPV variant A1 as represented by the prototype NL/1/00 (SEQ ID NO:358); if the amino acid sequence of its F protein is at least 98% or at least 99% or at least 99.5% identical to the F protein of a mammalian MPV variant A1 as represented by the prototype NL/1/00 (SEQ ID NO:314); if the amino acid sequence of its M2-1 protein is at least 99% or at least 99.5% identical to the M2-1 protein of a mammalian MPV variant A1 as represented by the prototype NL/1/00 (SEQ ID NO:338); if the amino acid sequence of its M2-2 protein is at least 96% or at least 99% or at least 99.5% identical to the M2-2 protein of a mammalian MPV variant A1 as represented by the prototype NL/1/00 (SEQ ID NO:346); if the amino acid sequence of its SH protein is at least 84%, at least 90%, at least 95%, at least 98%, or at least 99% or at least 99.5% identical to the SH protein of a mammalian MPV variant A1 as represented by the prototype NL/1/00 (SEQ ID NO:382); and/or if the amino acid sequence of its L protein is at least 99% or at least 99.5% identical to the L protein of a virus of a mammalian MPV variant A1 as represented by the prototype NL/1/00 (SEQ ID NO:330).

An isolate of mammalian MPV is classified as a variant A2 if it is phylogenetically closer related to the viral isolate NL/17/00 (SEQ ID NO:20) than it is related to any of the following other viral isolates: NL/1/99 (SEQ ID NO:18), NL/1/00 (SEQ ID NO:19) and NL/1/94 (SEQID NO:21). One or more of the ORFs of a mammalian MPV can be used to classify the mammalian MPV into a variant. A mammalian MPV can be classified as an MPV variant A2, if the amino acid sequence of its G protein is at least 66%, at least 70%, at least 75%, at least 80%, at least 85%, at least 90%, at least 95%, at least 98%, at least 99% or at least 99.5% identical to the G protein of a mammalian MPV variant A2 as represented by the prototype NL/17/00 (SEQ ID NO:332); if the amino acid sequence of its N protein is at least 99.5% identical to the N protein of a mammalian MPV variant A2 as represented by the prototype NL/17/00 (SEQ ID NO:367); if the amino acid sequence of its P protein is at least 96%, at least 98%, at least 99% or at least 99.5% identical to the P protein of a mammalian MPV variant A2 as represented by the prototype NL/17/00 (SEQ ID NO:375); if the amino acid sequence of its M protein is at least 99%, or at least 99.5% identical to the M protein of a mammalian MPV variant A2 as represented by the prototype NL/17/00 (SEQ ID NO:359); if the amino acid sequence of its F protein is at least 98%, at least 99% or at least 99.5% identical to the F protein of a mammalian MPV variant A2 as represented by the prototype NL/17/00 (SEQ ID NO:315); if the amino acid sequence of its M2-1 protein is at least 99%, or at least 99.5% identical to the M2-1 protein of a mammalian MPV variant A2 as represented by the prototype NL/17/00 (SEQ ID NO: 339); if the amino acid sequence of its M2-2 protein is at least 96%, at least 98%, at least 99% or at least 99.5% identical to the M2-2 protein of a mammalian MPV variant A2 as represented by the prototype NL/17/00 (SEQ ID NO:347); if the amino acid sequence of its SH protein is at least 84%, at least 85%, at least 90%, at least 95%, at least 98%, at least 99% or at least 99.5% identical to the SH protein of a mammalian MPV variant A2 as represented by the prototype NL/17/00 (SEQ ID NO:383); if the amino acid sequence of its L protein is at least 99% or at least 99.5% identical to the L protein of a mammalian MPV variant A2 as represented by the prototype NL/17/00 (SEQ ID NO:331).

An isolate of mammalian MPV is classified as a variant B2 if it is phylogenetically closer related to the viral isolate NL/1/94 (SEQ ID NO:21) than it is related to any of the following other viral isolates: NL/1/99 (SEQ ID NO:18), NL/1/00 (SEQ ID NO:19) and NL/17/00(SEQ ID NO:20). One or more of the ORFs of a mammalian MPV can be used to classify the mammalian MPV into a variant. A mammalian MPV can be classified as an MPV variant B2, if the amino acid sequence of its G protein is at least 66%, at least 70%, at least 75%, at least 80%, at least 85%, at least 90%, at least 95%, at least 98%, or at least 99% or at least 99.5% identical to the G protein of a mammalian MPV variant B2 as represented by the prototype NL/1/94 (SEQ ID NO:325); if the amino acid sequence of its N protein is at least 99% or at least 99.5% identical to the N protein of a mammalian MPV variant B2 as represented by the prototype NL/1/94 (SEQ ID NO:369); if the amino acid sequence of its P protein is at least 96%, at least 98%, or at least 99% or at least 99.5% identical to the P protein of a mammalian MPV variant B2 as represented by the prototype NL/1/94 (SEQ ID NO:377); if the amino acid sequence of its M protein is identical to the M protein of a mammalian MPV variant B2 as represented by the prototype NL/1/94 (SEQ ID NO:361); if the amino acid sequence of its F protein is at least 99% or at least 99.5% identical to the F protein of a mammalian MPV variant B2 as represented by the prototype NL/1/94 (SEQ ID NO:317); if the amino acid sequence of the M2-1 protein is at least 98% or at least 99% or at least 99.5% identical to the M2-1 protein of a mammalian MPV variant B2 as represented by the prototype NL/1/94 (SEQ ID NO:341); if the amino acid sequence that is at least 99% or at least 99.5% identical to the M2-2 protein of a mammalian MPV variant B2 as represented by the prototype NL/1/94 (SEQ ID NO:349); if the amino acid sequence of its SH protein is at least 84%, at least 85%, at least 90%, at least 95%, at least 98%, or at least 99% or at least 99.5% identical to the SH protein of a mammalian MPV variant B2 as represented by the prototype NL/1/94 (SEQ ID NO:385); and/or if the amino acid sequence of its L protein is at least 99% or at least 99.5% identical to the L protein of a mammalian MPV variant B2 as represented by the prototype NL/1/94 (SEQ ID NO:333).

In certain embodiments, the percentage of sequence identity is based on an alignment of the full length proteins. In other embodiments, the percentage of sequence identity is based on an alignment of contiguous amino acid sequences of the proteins, wherein the amino acid sequences can be 25 amino acids, 50 amino acids, 75 amino acids, 100 amino acids, 125 amino acids, 150 amino acids, 175 amino acids, 200 amino acids, 225 amino acids, 250 amino acids, 275 amino acids, 300 amino acids, 325 amino acids, 350 amino acids, 375 amino acids, 400 amino acids, 425 amino acids, 450 amino acids, 475 amino acids, 500 amino acids, 750 amino acids, 1000 amino acids, 1250 amino acids, 1500 amino acids, 1750 amino acids, 2000 amino acids or 2250 amino acids in length.

5.2 Functional Characteristics of a Mammalian MPV

In addition to the structural definitions of the mammalian MPV, a mammalian MPV can also be defined by its functional characteristics. In certain embodiments, the mammalian MPV of the invention is capable of infecting a mammalian host. The mammalian host can be a mammalian cell, tissue, organ or a mammal. In a specific embodiment, the mammalian host is a human or a human cell, tissue or organ. Any method known to the skilled artisan can be used to test whether the mammalian host has been infected with the mammalian MPV. In certain embodiments, the virus is tested for its ability to attach to a mammalian cell. In certain other embodiments, the virus is tested for its ability to transfer its genome into the mammalian cell. In an illustrative embodiment, the genome of the virus is detectably labeled, e.g., radioactively labeled. The virus is then incubated with a mammalian cell for at least 1 minute, at least 5 minutes at least 15 minutes, at least 30 minutes, at least 1 hour, at least 2 hours, at least 5 hours, at least 12 hours, or at least 1 day. The cells are subsequently washed to remove any viral particles from the cells and the cells are then tested for the presence of the viral genome by virtue of the detectable label. In another embodiment, the presence of the viral genome in the cells is detected using RT-PCR using mammalian MPV specific primers. (See, PCT WO 02/057302 at pp. 37 to 44, which is incorporated by reference herein).

In certain embodiments, the mammalian virus is capable to infect a mammalian host and to cause proteins of the mammalian MPV to be inserted into the cytoplasmic membrane of the mammalian host. The mammalian host can be a cultured mammalian cell, organ, tissue or mammal. In an illustrative embodiment, a mammalian cell is incubated with the mammalian virus. The cells are subsequently washed under conditions that remove the virus from the surface of the cell. Any technique known to the skilled artisan can be used to detect the newly expressed viral protein inserted in the cytoplasmic membrane of the mammalian cell. For example, after infection of the cell with the virus, the cells are maintained in medium comprising a detectably labeled amino acid. The cells are subsequently harvested, lysed, and the cytoplasmic fraction is separated from the membrane fraction. The proteins of the membrane fraction are then solubilized and then subjected to an immunoprecipitation using antibodies specific to a protein of the mammalian MPV, such as, but not limited to, the F protein or the G protein. The immunoprecipitated proteins are then subjected to SDS PAGE. The presence of viral protein can then be detected by autoradiography. In another embodiment, the presence of viral proteins in the cytoplasmic membrane of the host cell can be detected by immunocytochemistry using one or more antibodies specific to proteins of the mammalian MPV.

In even other embodiments, the mammalian MPV of the invention is capable of infecting a mammalian host and of replicating in the mammalian host. The mammalian host can be a cultured mammalian cell, organ, tissue or mammal. Any technique known to the skilled artisan can be used to determine whether a virus is capable of infecting a mammalian cell and of replicating within the mammalian host. In a specific embodiment, mammalian cells are infected with the virus. The cells are subsequently maintained for at least 30 minutes, at least 1 hour, at least 2 hours, at least 5 hours, at least 12 hours, at least 1 day, or at least 2 days. The level of viral genomic RNA in the cells can be monitored using Northern blot analysis, RT-PCR or in situ hybridization using probes that are specific to the viral genome. An increase in viral genomic RNA demonstrates that the virus can infect a mammalian cell and can replicate within a mammalian cell.

In even other embodiments, the mammalian MPV of the invention is capable of infecting a mammalian host, wherein the infection causes the mammalian host to produce new infectious mammalian MPV. The mammalian host can be a cultured mammalian cell or a mammal. Any technique known to the skilled artisan can be used to determine whether a virus is capable of infecting a mammalian host and cause the mammalian host to produce new infectious viral particles. In an illustrative example, mammalian cells are infected with a mammalian virus. The cells are subsequently washed and incubated for at least 30 minutes, at least 1 hour, at least 2 hours, at least 5 hours, at least 12 hours, at least 1 day, at least 2 days, at least one week, or at least twelve days. The titer of virus can be monitored by any method known to the skilled artisan. For exemplary methods see section 5.8.

In certain, specific embodiments, the mammalian MPV is a human MPV. The tests described in this section can also be performed with a human MPV. In certain embodiments, the human MPV is capable of infecting a mammalian host, such as a mammal or a mammalian cultured cell.

In certain embodiments, the human MPV is capable to infect a mammalian host and to cause proteins of the human MPV to be inserted into the cytoplasmic membrane of the mammalian host.

In even other embodiments, the human MPV of the invention is capable of infecting a mammalian host and of replicating in the mammalian host.

In even other embodiments, the human MPV of the invention is capable of infecting a mammalian host and of replicating in the mammalian host, wherein the infection and replication causes the mammalian host to produce and package new infectious human MPV.

In certain embodiments, the mammalian MPV, even though it is capable of infecting a mammalian host, is also capable of infecting an avian host, such as a bird or an avian cultured cell. In certain embodiments, the mammalian MPV is capable to infect an avian host and to cause proteins of the mammalian MPV to be inserted into the cytoplasmic membrane of the avian host. In even other embodiments, the mammalian MPV of the invention is capable of infecting an avian host and of replicating in the avian host. In even other embodiments, the mammalian MPV of the invention is capable of infecting an avian host and of replicating in the avian host, wherein the infection and replication causes the avian host to produce and package new infectious mammalian MPV.

5.3 Recombinant and Chimeric *Metapneumovirus*

The present invention encompasses recombinant or chimeric viruses encoded by viral vectors derived from the genomes of *metapneumovirus*, including both mammalian and avian variants. In accordance with the present invention a recombinant virus is one derived from a mammalian MPV or an APV that is encoded by endogenous or native genomic sequences or non-native genomic sequences. In accordance with the invention, a non-native sequence is one that is different from the native or endogenous genomic sequence due to one or more mutations, including, but not limited to, point mutations, rearrangements, insertions, deletions etc., to the genomic sequence that may or may not result in a phenotypic change. The recombinant viruses of the invention encompass those viruses encoded by viral vectors derived from the genomes of *metapneumovirus*, including both mammalian and avian variants, and may or may not, include nucleic acids that are non-native to the viral genome. In accordance with the present invention, a viral vector which is derived from the genome of a *metapneumovirus* is one that contains a nucleic acid sequence that encodes at least a part of one ORF of a mammalian *metapneumovirus*, wherein the polypeptides encoded by the ORF have amino acid sequence identity as set forth in Section 5.1. supra, and Table 1.

In accordance with the present invention, the recombinant viruses of the invention encompass those viruses encoded by viral vectors derived from the genome of a mammalian *metapneumovirus* (MPV), in particular a human *metapneumovirus*. In particular embodiments of the invention, the viral vector is derived from the genome of a *metapneumovirus* A1, A2, B1 or B2 variant. In accordance with the present invention, these viral vectors may or may not include nucleic acids that are non-native to the viral genome In accordance with the present invention, the recombinant viruses of the invention encompass those viruses encoded by viral vectors derived from the genome of an avian pneumovirus (APV), also known as turkey rhinotracheitis virus (TRTV). In particular embodiments of the invention, the viral vector is derived from the genome of an APV subgroup A, B, C or D. In a preferred embodiment, a viral vector derived from the genome of an APV subgroup C. In accordance with the present invention these viral vectors may or may not include nucleic acids that are non-native to the viral genome.

In another preferred embodiment of the invention, the recombinant viruses of the invention encompass those viruses encoded by a viral vector derived from the genome of an APV that contains a nucleic acid sequence that encodes a F-ORF of APV subgroup C. In certain embodiments, a viral vector derived from the genome of an APV is one that contains a nucleic acid sequence that encodes at least a N-ORF, a P-ORF, a M-ORF, a F-ORF, a M2-1-ORF, a M2-2-ORF or a L-ORF of APV.

In accordance with the invention, a chimeric virus is a recombinant MPV or APV which further comprises a heterologous nucleotide sequence. In accordance with the invention, a chimeric virus may be encoded by a nucleotide sequence in which heterologous nucleotide sequences have been added to the genome or in which endogenous or native nucleotide sequences have been replaced with heterologous nucleotide sequences.

In accordance with the invention, the chimeric viruses are encoded by the viral vectors of the invention which further comprise a heterologous nucleotide sequence. In accordance with the present invention a chimeric virus is encoded by a viral vector that may or may not include nucleic acids that are non-native to the viral genome. In accordance with the invention a chimeric virus is encoded by a viral vector to which heterologous nucleotide sequences have been added, inserted or substituted for native or non-native sequences. In accordance with the present invention, the chimeric virus may be encoded by nucleotide sequences derived from different strains of mammalian MPV. In particular, the chimeric virus is encoded by nucleotide sequences that encode antigenic polypeptides derived from different strains of MPV.

In accordance with the present invention, the chimeric virus may be encoded by a viral vector derived from the genome of an APV, in particular subgroup C, that additionally encodes a heterologous sequence that encodes antigenic polypeptides derived from one or more strains of MPV.

A chimeric virus may be of particular use for the generation of recombinant vaccines protecting against two or more viruses (Tao et al., J. Virol. 72, 2955-2961; Durbin et al., 2000, J.Virol. 74, 6821-6831; Skiadopoulos et al., 1998, J. Virol. 72, 1762-1768; Teng et al., 2000, J.Virol. 74, 9317-9321). For example, it can be envisaged that a MPV or APV virus vector expressing one or more proteins of another negative strand RNA virus, e.g., RSV or a RSV vector expressing one or more proteins of MPV will protect individuals vaccinated with such vector against both virus infections. A similar approach can be envisaged for PIV or other paramyxoviruses. Attenuated and replication-defective viruses may be of use for vaccination purposes with live vaccines as has been suggested for other viruses. (See, PCT WO 02/057302, at pp. 6 and 23, incorporated by reference herein).

In accordance with the present invention the heterologous sequence to be incorporated into the viral vectors encoding the recombinant or chimeric viruses of the invention include sequences obtained or derived from different strains of *metapneumovirus*, strains of avian pneumovirus, and other negative strand RNA viruses, including, but not limited to, RSV, PIV and influenza virus, and other viruses, including morbillivirus.

In certain embodiments of the invention, the chimeric or recombinant viruses of the invention are encoded by viral vectors derived from viral genomes wherein one or more sequences, intergenic regions, termini sequences, or portions or entire ORF have been substituted with a heterologous or non-native sequence. In certain embodiments of the invention, the chimeric viruses of the invention are encoded by viral vectors derived from viral genomes wherein one or more heterologous sequences have been added to the vector.

In certain embodiments, the virus of the invention contains heterologous nucleic acids. In a preferred embodiment, the heterologous nucleotide sequence is inserted or added at Position 1 of the viral genome. In another preferred embodiment, the heterologous nucleotide sequence is inserted or added at Position 2 of the viral genome. In even another preferred embodiment, the heterologous nucleotide sequence is inserted or added at Position 3 of the viral genome. Insertion or addition of nucleic acid sequences at the lower-numbered positions of the viral genome results in stronger or higher levels of expression of the heterologous nucleotide sequence compared to insertion at higher-numbered positions due to a transcriptional gradient across the genome of the virus. Thus, inserting or adding heterologous nucleotide sequences at lower-numbered positions is the preferred embodiment of the invention if high levels of expression of the heterologous nucleotide sequence is desired.

Without being bound by theory, the position of insertion or addition of the heterologous sequence affects the replication rate of the recombinant or chimeric virus. The higher rates of replication can be achieved if the heterologous sequence is inserted or added at Position 2 or Position 1 of the viral genome. The rate of replication is reduced if the heterologous sequence is inserted or added at Position 3, Position 4, Position 5, or Position 6.

Without being bound by theory, the size of the intergenic region between the viral gene and the heterologous sequence further determines rate of replication of the virus and expression levels of the heterologous sequence.

In certain embodiments, the viral vector of the invention contains two or more different heterologous nucleotide sequences. In a preferred embodiment, one heterologous nucleotide sequence is at Position 1 and a second heterologous nucleotide sequence is at Position 2 of the viral genome. In another preferred embodiment, one heterologous nucleotide sequence is at Position 1 and a second heterologous nucleotide sequence is at Position 3 of the viral genome. In even another preferred embodiment, one heterologous nucleotide sequence is at Position 2 and a second heterologous nucleotide sequence is at Position 3 of the viral genome. In certain other embodiments, a heterologous nucleotide sequence is inserted at other, higher-numbered positions of the viral genome. In accordance with the present invention, the position of the heterologous sequence refers to the order in which the sequences are transcribed from the viral genome, e.g., a heterologous sequence at Position 1 is the first gene sequence to be transcribed from the genome.

The selection of the viral vector may depend on the species of the subject that is to be treated or protected from a viral infection. If the subject is human, then an attenuated mammalian *metapneumovirus* or an avian pneumovirus can be used to provide the antigenic sequences.

In accordance with the present invention, the viral vectors can be engineered to provide antigenic sequences which confer protection against infection by a *metapneumovirus*, including sequences derived from mammalian *metapneumovirus*, human *metapneumovirus*, MPV variants A1, A2, B1 or B2, sequences derived from avian pneumovirus, including APV subgroups A, B, C or D, although C is preferred. The viral vectors can be engineered to provide antigenic sequences which confer protection against infection or disease by another virus, including negative strand RNA virus, including influenza, RSV or PIV, including PIV3. The viral vectors may be engineered to provide one, two, three or more antigenic sequences. In accordance with the present invention the antigenic sequences may be derived from the same virus, from different strains or variants of the same type of virus, or from different viruses, including morbillivirus.

In certain embodiments of the invention, the heterologous nucleotide sequence to be inserted into the genome of the virus of the invention is derived from a *metapneumovirus*. In certain specific embodiments of the invention, the heterologous nucleotide sequence is derived from a human *metapneumovirus*. In another specific embodiment, the heterologous nucleotide sequence is derived from an avian pneumovirus. More specifically, the heterologous nucleotide sequence of the invention encodes a F gene of a human *metapneumovirus*. More specifically, the heterologous nucleotide sequence of the invention encodes an G gene of a human *metapneumovirus*. More specifically, the heterologous nucleotide sequence of the invention encodes a F gene of an avian pneumovirus. More specifically, the heterologous nucleotide sequence of the invention encodes a G gene of an avian pneumovirus. In specific embodiments, a heterologous nucleotide sequences can be any one of SEQ ID NO:1 through SEQ ID NO:5, SEQ ID NO:14, and SEQ ID NO:15. In certain specific embodiments, the nucleotide sequence encodes a protein of any one of SEQ ID NO:6 through SEQ ID NO:13, SEQ ID NO:16, and SEQ ID NO:17.

In a specific embodiment of the invention, the heterologous nucleotide sequence encodes a chimeric F protein. In an illustrative embodiment, the ectodomain of the chimeric F-protein is the ectodomain of a human MPV and the transmembrane domain and the luminal domain are derived from the F-protein of an avian *metapneumovirus*. Without being bound by theory, a chimeric human MPV that encodes the chimeric F-protein consisting of the human ectodomain and the avian luminol/transmembrane domain is attenuated because of the avian part of the F-protein, yet highly immunogenic against hMPV because of the human ectodomain.

In certain embodiments, two different heterologous nucleotide sequences are inserted or added to the viral vectors of the invention, derived from metapneumoviral genomes, including mammalian and avian. For example, the heterologous nucleotide sequence is derived from a human *metapneumovirus*, an avian pneumovirus, RSV, PIV, or influenza. In a preferred embodiment, the heterologous sequence encodes the F-protein of human *metapneumovirus*, avian pneumovirus, RSV or PIV respectively. In another embodiment, the heterologous sequence encodes the HA protein of influenza.

In certain embodiments, the viral vector of the invention contains two different heterologous nucleotide sequences wherein a first heterologous nucleotide sequence is derived from a *metapneumovirus*, such as a human *metapneumovirus* or an avian pneumovirus, and a second nucleotide sequence is derived from a respiratory syncytial virus (see Table 2). In specific embodiments, the heterologous nucleotide sequence derived from respiratory syncytial virus is a F gene of a respiratory syncytial virus. In other specific embodiments, the heterologous nucleotide sequence derived from respiratory syncytial virus is a G gene of a respiratory syncytial virus. In a specific embodiment, the heterologous nucleotide sequence derived from a *metapneumovirus* is inserted at a lower-numbered position than the heterologous nucleotide sequence derived from a respiratory syncytial virus. In another specific embodiment, the heterologous nucleotide sequence derived from a *metapneumovirus* is inserted at a higher-numbered position than the heterologous nucleotide sequence derived from a respiratory syncytial virus.

In certain embodiments, the virus of the invention contains two different heterologous nucleotide sequences wherein a first heterologous nucleotide sequence is derived from a *metapneumovirus*, such as a human *metapneumovirus* or an avian pneumovirus, and a second nucleotide sequence is derived from a parainfluenza virus, such as, but not limited to PIV3 (see Table 2). In specific embodiments, the heterologous nucleotide sequence derived from PIV is a F gene of PIV. In other specific embodiments, the heterologous nucleotide sequence derived from PIV is a G gene of a PIV. In a specific embodiment, the heterologous nucleotide sequence derived from a *metapneumovirus* is inserted at a lower-numbered position than the heterologous nucleotide sequence derived from a PIV. In another specific embodiment, the heterologous nucleotide sequence derived from a *metapneumovirus* is inserted at a higher-numbered position than the heterologous nucleotide sequence derived from a PIV.

The expression products and/or recombinant or chimeric virions obtained in accordance with the invention may advantageously be utilized in vaccine formulations. The expression products and chimeric virions of the present invention may be engineered to create vaccines against a broad range of pathogens, including viral and bacterial antigens, tumor antigens, allergen antigens, and auto antigens involved in autoimmune disorders. In particular, the chimeric virions of the present invention may be engineered to create vaccines for the protection of a subject from infections with PIV, RSV, and/or *metapneumovirus*.

In another embodiment, the chimeric virions of the present invention may be engineered to create anti-HIV vaccines, wherein an immunogenic polypeptide from gp160, and/or from internal proteins of HIV is engineered into the glycoprotein HN protein to construct a vaccine that is able to elicit both vertebrate humoral and cell-mediated immune responses. In yet another embodiment, the invention relates to recombinant metapneumoviral vectors and viruses which are engineered to encode mutant antigens. A mutant antigen has at least one amino acid substitution, deletion or addition relative to the wild-type viral protein from which it is derived.

In certain embodiments, the invention relates to trivalent vaccines comprising a recombinant or chimeric virus of the invention. In specific embodiments, the virus used as backbone for a trivalent vaccine is a chimeric avian-human *metapneumovirus* or a chimeric human-avian *metapneumovirus* containing a first heterologous nucleotide sequence derived from a RSV and a second heterologous nucleotide sequence derived from PIV. In an exemplary embodiment, such a trivalent vaccine will be specific to (a) the gene products of the F gene and/or the G gene of the human *metapneumovirus* or avian pneumovirus, respectively, dependent on whether chimeric avian-human or chimeric human-avian *metapneumovirus* is used; (b) the protein encoded by the heterologous nucleotide sequence derived from a RSV; and (c) the protein encoded by the heterologous nucleotide sequence derived from PIV. In a specific embodiment, the first heterologous nucleotide sequence is the F gene of the respiratory syncytial virus and is inserted in Position 1, and the second heterologous nucleotide sequence is the F gene of the PIV and is inserted in Position 3. Many more combinations are encompassed by the present invention and some are shown by way of example in Table 2. Further, nucleotide sequences encoding chimeric F proteins could be used (see supra). In some less preferred embodiments, the heterologous nucleotide sequence can be inserted at higher-numbered positions of the viral genome.

TABLE 2

Exemplary arrangements of heterologous nucleotide sequences in the viruses used for trivalent vaccines.

| Combination | Position 1 | Position 2 | Position 3 |
|---|---|---|---|
| 1 | F-gene of PIV | F-gene of RSV | — |
| 2 | F-gene of RSV | F-gene of PIV | — |
| 3 | — | F-gene of PIV | F-gene of RSV |
| 4 | — | F-gene of RSV | F-gene of PIV |
| 5 | F-gene of PIV | — | F-gene of RSV |
| 6 | F-gene of RSV | — | F-gene of PIV |
| 7 | HN-gene of PIV | G-gene of RSV | — |
| 8 | G-gene of RSV | HN-gene of PIV | — |
| 9 | — | HN-gene of PIV | G-gene of RSV |
| 10 | — | G-gene of RSV | HN-gene of PIV |
| 11 | HN-gene of PIV | — | G-gene of RSV |
| 12 | G-gene of RSV | — | HN-gene of PIV |
| 13 | F-gene of PIV | G-gene of RSV | — |
| 14 | G-gene of RSV | F-gene of PIV | — |
| 15 | — | F-gene of PIV | G-gene of RSV |
| 16 | — | G-gene of RSV | F-gene of PIV |
| 17 | F-gene of PIV | — | G-gene of RSV |
| 18 | G-gene of RSV | — | F-gene of PIV |
| 19 | HN-gene of PIV | F-gene of RSV | — |
| 20 | F-gene of RSV | HN-gene of PIV | — |
| 21 | — | HN-gene of PIV | F-gene of RSV |
| 22 | — | F-gene of RSV | HN-gene of PIV |
| 23 | HN-gene of PIV | — | F-gene of RSV |
| 24 | F-gene of RSV | — | HN-gene of PIV |

In certain embodiments, the expression products and recombinant or chimeric virions of the present invention may be engineered to create vaccines against a broad range of pathogens, including viral antigens, tumor antigens and auto antigens involved in autoimmune disorders. One way to achieve this goal involves modifying existing metapneumoviral genes to contain foreign sequences in their respective external domains. Where the heterologous sequences are epitopes or antigens of pathogens, these chimeric viruses may be used to induce a protective immune response against the disease agent from which these determinants are derived.

Thus, the present invention relates to the use of viral vectors and recombinant or chimeric viruses to formulate vaccines against a broad range of viruses and/or antigens. The viral vectors and chimeric viruses of the present invention may be used to modulate a subject's immune system by stimulating a humoral immune response, a cellular immune response or by stimulating tolerance to an antigen. As used herein, a subject means: humans, primates, horses, cows, sheep, pigs, goats, dogs, cats, avian species and rodents.

The invention may be divided into the following stages solely for the purpose of description and not by way of limitation: (a) construction of recombinant cDNA and RNA templates; (b) expression of heterologous gene products using recombinant cDNA and RNA templates; (c) rescue of the heterologous gene in recombinant virus particles; and (d) generation and use of vaccines comprising the recombinant virus particles of the invention.

5.4 Construction of the Recombinant cDNA and RNA

In certain embodiments, the viral vectors are derived from the genomes of human or mammalian *metapneumovirus* of the invention. In other embodiments, the viral vectors are derived from the genome of avian pneumovirus. In certain embodiments, viral vectors contain sequences derived from mammalian MPV and APV, such that a chimeric human MPV/APV virus is encoded by the viral vector. In an exemplary embodiment, the F-gene and/or the G-gene of human *metapneumovirus* have been replaced with the F-gene and/or the G-gene of avian pneumovirus to construct chimeric hMPV/APV virus. In other embodiments, viral vectors contain sequences derived from APV and mammalian MPV, such that a chimeric APV/hMPV virus is encoded by the viral vector. In more exemplary embodiments, the F-gene and/or the G-gene of avian pneumovirus have been replaced with the F-gene and/or the G-gene of human metapneumovirus to construct the chimeric APV/hMPV virus.

The present invention also encompasses recombinant viruses comprising a viral vector derived from a mammalian MPV or APV genome containing sequences endogenous or native to the viral genome, and may or may not contain sequences non-native to the viral genome. Non-native sequences include those that are different from native or endogenous sequences which may or may not result in a phenotypic change. The recombinant viruses of the invention may contain sequences which result in a virus having a phenotype more suitable for use in vaccine formulations, e.g., attenuated phenotype or enhanced antigenicity. The mutations and modifications can be in coding regions, in intergenic regions and in the leader and trailer sequences of the virus.

In certain embodiments the viral vectors of the invention comprise nucleotide sequences derived from hMPV, APV, hMPV/APV or APV/hMPV, in which native nucleotide sequences have been substituted with heterologous sequences or in which heterologous sequences have been added to the native metapneumoviral sequences.

In a more specific embodiment, a chimeric virus comprises a viral vector derived from MPV, APV, APV/hMPV, or hMPV/APV in which heterologous sequences derived from PIV have been added. In a more specific embodiment, a recombinant virus comprises a viral vector derived from MPV, APV, APV/hMPV, or hMPV/APV in which sequences have been replaced by heterologous sequences derived from PIV. In other specific embodiments, a chimeric virus comprises a viral vector derived from MPV, APV, APV/hMPV, or hMPV/APV in which heterologous sequences derived from RSV have been added. In a more specific embodiment, a chimeric virus comprises a viral vector derived from MPV, APV, APV/hMPV, or hMPV/APV in which sequences have been replaced by heterologous sequences derived from RSV.

Heterologous gene coding sequences flanked by the complement of the viral polymerase binding site/promoter, e.g., the complement of 3'-hMPV virus terminus of the present invention, or the complements of both the 3'- and 5'-hMPV virus termini may be constructed using techniques known in the art. In more specific embodiments, a recombinant virus of the invention contains the leader and trailer sequence of hMPV or APV. In certain embodiments, the intergenic regions are obtained from hMPV or APV. The resulting RNA templates may be of the negative-polarity and contain appropriate terminal sequences which enable the viral RNA-synthesizing apparatus to recognize the template. Alternatively, positive-polarity RNA templates which contain appropriate terminal sequences which enable the viral RNA-synthesizing apparatus to recognize the template, may also be used. Recombinant DNA molecules containing these hybrid sequences can be cloned and transcribed by a DNA-directed RNA polymerase, such as bacteriophage T7, T3, the SP6 polymerase or eukaryotic polymerase such as polymerase I and the like, to produce in vitro or in vivo the recombinant RNA templates which possess the appropriate viral sequences that allow for viral polymerase recognition and activity. In a more specific embodiment, the RNA polymerase is fowlpox virus T7 RNA polymerase or a MVA T7 RNA polymerase.

An illustrative approach for constructing these hybrid molecules is to insert the heterologous nucleotide sequence into a DNA complement of a hMPV, APV, APV/hMPV or hMPV/APV genome, so that the heterologous sequence is flanked by the viral sequences required for viral polymerase activity; i.e., the viral polymerase binding site/promoter, hereinafter referred to as the viral polymerase binding site, and a polyadenylation site. In a preferred embodiment, the heterologous coding sequence is flanked by the viral sequences that comprise the replication promoters of the 5' and 3' termini, the gene start and gene end sequences, and the packaging signals that are found in the 5' and/or the 3' termini. In an alternative approach, oligonucleotides encoding the viral polymerase binding site, e.g., the complement of the 3'-terminus or both termini of the virus genomic segment can be ligated to the heterologous coding sequence to construct the hybrid molecule. The placement of a foreign gene or segment of a foreign gene within a target sequence was formerly dictated by the presence of appropriate restriction enzyme sites within the target sequence. However, recent advances in molecular biology have lessened this problem greatly. Restriction enzyme sites can readily be placed anywhere within a target sequence through the use of site-directed mutagenesis (e.g., see, for example, the techniques described by Kunkel, 1985, Proc. Natl. Acad. Sci. U.S.A. 82;488). Variations in polymerase chain reaction (PCR) technology, described infra, also allow for the specific insertion of sequences (i.e., restriction enzyme sites) and allow for the facile construction of hybrid molecules. Alternatively, PCR reactions could be used to prepare recombinant templates without the need of cloning. For example, PCR reactions could be used to prepare double-stranded DNA molecules containing a DNA-directed RNA polymerase promoter (e.g., bacteriophage T3, T7 or SP6) and the hybrid sequence containing the heterologous gene and the PIV polymerase binding site. RNA templates could then be transcribed directly from this recombinant DNA. In yet another embodiment, the recombinant RNA templates may be prepared by ligating RNAs specifying the negative polarity of the heterologous gene and the viral polymerase binding site using an RNA ligase.

In addition, one or more nucleotides can be added in the untranslated region to adhere to the "Rule of Six" which may be important in obtaining virus rescue. The "Rule of Six" applies to many paramyxoviruses and states that the RNA nucleotide genome must be divisible by six to be functional. The addition of nucleotides can be accomplished by techniques known in the art such as using a commercial mutagenesis kits such as the QuikChange mutagenesis kit (Stratagene). After addition of the appropriate number of nucleotides, the correct DNA fragment can then be isolated by digestion with appropriate restriction enzyme and gel purification. Sequence requirements for viral polymerase activity and constructs which may be used in accordance with the invention are described in the subsections below.

Without being bound by theory, several parameters affect the rate of replication of the recombinant virus and the level of expression of the heterologous sequence. In particular, the position of the heterologous sequence in hMPV, APV, hMPV/APV or APV/hMPV and the length of the intergenic region that flanks the heterologous sequence determine rate of replication and expression level of the heterologous sequence.

In certain embodiments, the leader and or trailer sequence of the virus are modified relative to the wild type virus. In certain more specific embodiments, the lengths of the leader and/or trailer are altered. In other embodiments, the sequence(s) of the leader and/or trailer are mutated relative to the wild type virus. For more detail, see section 5.7.

The production of a recombinant virus of the invention relies on the replication of a partial or full-length copy of the negative sense viral RNA (vRNA) genome or a complementary copy thereof (cRNA). This vRNA or cRNA can be isolated from infectious virus, produced upon in-vitro transcription, or produced in cells upon transfection of nucleic acids. Second, the production of recombinant negative strand virus relies on a functional polymerase complex. Typically, the polymerase complex of pneumoviruses consists of N, P, L and possibly M2 proteins, but is not necessarily limited thereto.

Polymerase complexes or components thereof can be isolated from virus particles, isolated from cells expressing one or more of the components, or produced upon transfection of specific expression vectors.

Infectious copies of MPV can be obtained when the above mentioned vRNA, cRNA, or vectors expressing these RNAs are replicated by the above mentioned polymerase complex 16 (Schnell et al., 1994, EMBO J 13: 4195-4203; Collins, et al., 1995, PNAS 92: 11563-11567; Hoffmann, et al., 2000, PNAS 97: 6108-6113; Bridgen, et al., 1996, PNAS 93: 15400-15404; Palese, et al., 1996, PNAS 93: 11354-11358; Peeters, et al., 1999, J.Virol. 73: 5001-5009; Durbin, et al., 1997, Virology 235: 323-332).

The invention provides a host cell comprising a nucleic acid or a vector according to the invention. Plasmid or viral vectors containing the polymerase components of MPV (presumably N, P, L and M2, but not necessarily limited thereto) are generated in prokaryotic cells for the expression of the components in relevant cell types (bacteria, insect cells, eukaryotic cells). Plasmid or viral vectors containing full-length or partial copies of the MPV genome will be generated in prokaryotic cells for the expression of viral nucleic acids in-vitro or in-vivo. The latter vectors may contain other viral sequences for the generation of chimeric viruses or chimeric virus proteins, may lack parts of the viral genome for the generation of replication defective virus, and may contain mutations, deletions or insertions for the generation of attenuated viruses.

Infectious copies of MPV (being wild type, attenuated, replication-defective or chimeric) can be produced upon co-expression of the polymerase components according to the state-of-the-art technologies described above.

In addition, eukaryotic cells, transiently or stably expressing one or more full-length or partial MPV proteins can be used. Such cells can be made by transfection (proteins or nucleic acid vectors), infection (viral vectors) or transduction (viral vectors) and may be useful for complementation of mentioned wild type, attenuated, replication-defective or chimeric viruses.

5.4.1 Heterologous Gene Sequences to be Inserted

In accordance with the present invention the viral vectors of the invention may be further engineered to express a heterologous sequence. In an embodiment of the invention, the heterologous sequence is derived from a source other than the viral vector. By way of example, and not by limitation, the heterologous sequence encodes an antigenic protein, polypeptide or peptide of a virus belonging to a different species, subgroup or variant of *metapneumovirus* than the species, subgroup or variant from which the viral vector is derived. By way of example, and not by limitation, the heterologous sequence encodes an antigenic protein, polypeptide or peptide of a virus other than a *metapneumovirus*. By way of example, and not by limitation, the heterologous sequence is not viral in origin. In accordance with this embodiment, the heterologous sequence may encode a moiety, peptide, polypeptide or protein possessing a desired biological property or activity. Such a heterologous sequence may encode a tag or marker. Such a heterologous sequence may encode a biological response modifier, examples of which include, lymphokines, interleukines, granulocyte macrophage colony stimulating factor and granulocyte colony stimulating factor.

In certain embodiments, the heterologous nucleotide sequence to be inserted is derived from a *metapneumovirus*. More specifically, the heterologous nucleotide sequence to be inserted is derived from a human *metapneumovirus* and/or an avian pneumovirus.

In certain embodiments, the heterologous sequence encodes PIV nucleocapsid phosphoprotein, PIV L protein, PIV matrix protein, PIV HN glycoprotein, PIV RNA-dependent RNA polymerase, PIV Y1 protein, PIV D protein, PIV C protein, PIV F protein or PIV P protein. In certain embodiments, the heterologous nucleotide sequence encodes a protein that is at least 90%, at least 95%, at least 98%, or at least 99% homologous to PIV nucleocapsid phosphoprotein, PIV L protein, PIV matrix protein, PIV HN glycoprotein, PIV RNA-dependent RNA polymerase, PIV Y1 protein, PIV D protein, PIV C protein, PIV F protein or PIV P protein. The heterologous sequence can be obtained from PIV type 1, PIV type 2, or PIV type 3. In more specific embodiments, the heterologouse sequence is obtained from human PIV type 1, PIV type 2, or PUV type 3. In other embodiments, the heterologous sequence encodes RSV nucleoprotein, RSV phosphoprotein, RSV matrix protein, RSV small hydrophobic protein, RSV RNA-dependent RNA polymerase, RSV F protein, RSV G protein, or RSV M2-1 or M2-2 protein. In certain embodiments, the heterologous sequence encodes a protein that is at least 90%, at least 95%, at least 98%, or at least 99% homologous to RSV nucleoprotein, RSV phosphoprotein, RSV matrix protein, RSV small hydrophobic protein, RSV RNA-dependent RNA polymerase, RSV F protein, or RSV G protein. The heterologous sequence can be obtained from RSV subtype A and RSV subtype B. In more specific embodiments, the heterologouse sequence is obtained from human RSV subtype A and RSV subtype B. In other embodiments, the heterologous sequence encodes APV nucleoprotein, APV phosphoprotein, APV matrix protein, APV small hydrophobic protein, APV RNA-dependent RNA polymerase, APV F protein, APV G protein or APV M2-1 or M2-2 protein. In certain embodiments, the heterologous sequence encodes a protein that is at least 90%, at least 95%, at least 98%, or at least 99% homologous to APV nucleoprotein, APV phosphoprotein, APV matrix protein, APV small hydrophobic protein, APV RNA-dependent RNA polymerase, APV F protein, or APV G protein. The avian pneumovirus can be APV subgroup A, APV subgroup B, or APV subgroup C. In other embodiments, the heterologous sequence encodes hMPV nucleoprotein, hMPV phosphoprotein, hMPV matrix protein, hMPV small hydrophobic protein, hMPV RNA-dependent RNA polymerase, hMPV F protein, hMPV G protein or hMPV M2-1 or M2-2. In certain embodiments, the heterologous sequence encodes a protein that is at least 90%, at least 95%, at least 98%, or at least 99% homologous to hMPV nucleoprotein, hMPV phosphoprotein, hMPV matrix protein, hMPV small hydrophobic protein, hMPV RNA-dependent RNA polymerase, hMPV F protein, or hMPV G protein. The human *metapneumovirus* can be hMPV variant A1, hMPV variant A2, hMPV variant B1, or hMPV variant B2.

In certain embodiments, any combination of different heterologous sequence from PIV, RSV, human *metapneumovirus*, or avian pneumovirus can be inserted into the virus of the invention.

In certain preferred embodiments of the invention, the heterologous nucleotide sequence to be inserted is derived from a F gene from RSV, PIV, APV or hMPV.

In certain embodiments, the heterologous nucleotide sequence encodes a chimeric protein. In more specific embodiments, the heterologous nucleotide sequence encodes a chimeric F protein of RSV, PIV, APV or hMPV. A chimeric F protein can comprise parts of F proteins from different viruses, such as a human *metapneumovirus*, avian pneumovirus, respiratory syncytial virus, and parainfluenza virus. In certain other embodiments, the heterologous sequence encodes a chimeric G protein. A chimeric G protein comprises parts of G proteins from different viruses, such as a human *metapneumovirus*, avian pneumovirus, respiratory syncytial virus, and parainfluenza virus. In a specific embodiment, the F protein comprises an ectodomain of a F protein of a *metapneumovirus*, a transmembrane domain of a F protein of a parainfluenza virus, and luminal domain of a F protein of a parainfluenza virus.

In certain specific embodiments, the heterologous nucleotide sequence of the invention is any one of SEQ ID NO:1 through SEQ ID NO:5, SEQ ID NO:14, and SEQ ID NO:15. In certain specific embodiments, the nucleotide sequence encodes a protein of any one of SEQ ID NO:6 through SEQ ID NO:13, SEQ ID NO:16, and SEQ ID NO:17.

For heterologous nucleotide sequences derived from respiratory syncytial virus see, e.g., PCT/US98/20230, which is hereby incorporated by reference in its entirety.

In a preferred embodiment, heterologous gene sequences that can be expressed into the recombinant viruses of the invention include but are not limited to antigenic epitopes and glycoproteins of viruses which result in respiratory disease, such as influenza glycoproteins, in particular hemagglutinin H5, H7, respiratory syncytial virus epitopes, New Castle Disease virus epitopes, Sendai virus and infectious Laryngotracheitis virus (ILV). In a preferred embodiment, the heterologous nucleotide sequences are derived from a RSV or PIV. In yet another embodiment of the invention, heterologous gene sequences that can be engineered into the chimeric viruses of the invention include, but are not limited to, viral epitopes and glycoproteins of viruses, such as hepatitis B virus surface antigen, hepatitis A or C virus surface glycoproteins of Epstein Barr virus, glycoproteins of human papilloma virus, simian virus 5 or mumps virus, West Nile virus, Dengue virus, glycoproteins of herpes viruses, VPI of poliovirus, and sequences derived from a lentivirus, preferably, but not limited to human immunodeficiency virus (HIV) type 1 or type 2. In yet another embodiment, heterologous gene sequences that can be engineered into chimeric viruses of the invention include, but are not limited to, Marek's Disease virus (MDV) epitopes, epitopes of infectious Bursal Disease virus (IBDV), epitopes of Chicken Anemia virus, infectious laryngotracheitis virus (ILV), Avian Influenza virus (AIV), rabies, feline leukemia virus, canine distemper virus, vesicular stomatitis virus, and swinepox virus (seeFields et al., (ed.), 1991, *Fundamental Virology, Second Edition*, Raven Press, New York, incorporated by reference herein in its entirety).

Other heterologous sequences of the present invention include antigens that are characteristic of autoimmune disease. These antigens will typically be derived from the cell surface, cytoplasm, nucleus, mitochondria and the like of mammalian tissues, including antigens characteristic of diabetes mellitus, multiple sclerosis, systemic lupus erythematosus, rheumatoid arthritis, pernicious anemia, Addison's disease, scleroderna, autoimmune atrophic gastritis, juvenile diabetes, and discold lupus erythromatosus.

Antigens that are allergens generally include proteins or glycoproteins, including antigens derived from pollens, dust, molds, spores, dander, insects and foods. In addition, antigens that are characteristic of tumor antigens typically will be derived from the cell surface, cytoplasm, nucleus, organelles and the like of cells of tumor tissue. Examples include antigens characteristic of tumor proteins, including proteins encoded by mutated oncogenes; viral proteins associated with tumors; and glycoproteins. Tumors include, but are not limited to, those derived from the types of cancer: lip, nasopharynx, pharynx and oral cavity, esophagus, stomach, colon, rectum, liver, gall bladder, pancreas, larynx, lung and bronchus, melanoma of skin, breast, cervix, uterine, ovary, bladder, kidney, uterus, brain and other parts of the nervous system, thyroid, prostate, testes, Hodgkin's disease, non-Hodgkin's lymphoma, multiple myeloma and leukemia.

In one specific embodiment of the invention, the heterologous sequences are derived from the genome of human immunodeficiency virus (HIV), preferably human immunodeficiency virus-1 or human immunodeficiency virus-2. In another embodiment of the invention, the heterologous coding sequences may be inserted within a gene coding sequence of the viral backbone such that a chimeric gene product is expressed which contains the heterologous peptide sequence within the metapneumoviral protein. In such an embodiment of the invention, the heterologous sequences may also be derived from the genome of a human immunodeficiency virus, preferably of human immunodeficiency virus-1 or human immunodeficiency virus-2.

In instances whereby the heterologous sequences are HIV-derived, such sequences may include, but are not limited to sequences derived from the env gene (i.e., sequences encoding all or part of gp160, gp120, and/or gp41), the pol gene (i.e., sequences encoding all or part of reverse transcriptase, endonuclease, protease, and/or integrase), the gag gene (i.e., sequences encoding all or part of p7, p6, p55, p17/18, p24/25) tat, rev, nef, vif, vpu, vpr, and/or vpx.

In yet another embodiment, heterologous gene sequences that can be engineered into the chimeric viruses include those that encode proteins with immunopotentiating activities. Examples of immunopotentiating proteins include, but are not limited to, cytokines, interferon type 1, gamma interferon, colony stimulating factors, and interleukin-1, -2, -4, -5, -6, -12.

In addition, other heterologous gene sequences that may be engineered into the chimeric viruses include antigens derived from bacteria such as bacterial surface glycoproteins, antigens derived from fungi, and antigens derived from a variety of other pathogens and parasites. Examples of heterologous gene sequences derived from bacterial pathogens include, but are not limited to, antigens derived from species of the following genera: *Salmonella, Shigella, Chlamydia, Helicobacter, Yersinia, Bordatella, Pseudomonas, Neisseria, Vibrio, Haemophilus, Mycoplasma, Streptomyces, Treponema, Coxiella, Ehrlichia, Brucella, Streptobacillus, Fusospirocheta, Spirillum, Ureaplasma, Spirochaeta, Mycoplasma, Actinomycetes, Borrelia, Bacteroides, Trichomoras, Branhamella, Pasteurella, Clostridium, Corynebacterium, Listeria, Bacillus, Erysipelothrix, Rhodococcus, Escherichia, Klebsiella, Pseudomanas, Enterobacter, Serratia, Staphylococcus, Streptococcus, Legionella, Mycobacterium, Proteus, Campylobacter, Enterococcus, Acinetobacter, Morganella, Moraxella, Citrobacter, Rickettsia, Rochlimeae*, as well as bacterial species such as: *P. aeruginosa; E. coli, P. cepacia, S. epidermis, E. faecalis, S. pneumonias, S. aureus, N. meningitidis, S. pyogenes, Pasteurella niultocida, Treponema pallidum*, and *P. mirabilis*.

Examples of heterologous gene sequences derived from pathogenic fungi, include, but are not limited to, antigens derived from fungi such as *Cryptococcus neoformans; Blastomyces dermatitidis; Aiellomyces derinatitidis; Histoplasma capsulatum; Coccidioides immitis; Candida* species, including *C. albicans, C. tropicalis, C. parapsilosis, C. guilliermondii* and *C. krusei, Aspergillus* species, including *A. fumigatus, A. flavus* and *A. niger, Rhizopus* species; *Rhizoniucor* species; *Cunninghammella* species; *Apophysomyces* species, including *A. saksenaea, A. mucor* and *A. absidia; Sporothrix schenckii, Paracoccidioides brasiliensis; Pseudallescheria boydii, Torulopsis glabrata, Trichophyton* species, *Microsporum* species and *Dermatophyres* species, as well as any other yeast or fungus now known or later identified to be pathogenic.

Finally, examples of heterologous gene sequences derived from parasites include, but are not limited to, antigens derived from members of the Apicomplexa phylum such as, for example, *Babesia, Toxoplasma, Plasinodiuni, Eineria, Isospora, Atoxoplasma, Cystoisospora, Hamniondia, Besniotia, Sarcocystis, Frenkelia, Haemoproteus, Leucocytozoon, Theileria, Perkinsus* and *Gregarina* spp.; *Pneumocystis carinii*; members of the Microspora phylum such as, for example, *Nosenia, Enterocytozoon, Encephalitozoon, Septata, Mrazekia, Aniblyospora, Ameson, Glugea, Pleistophora* and *Microsporidium* spp.; and members of the Ascetospora phylum such as, for example, *Haplosporidium* spp., as well as species including *Plasmodium falciparum, P. vivax, P. ovale, P. malaria; Toxoplasma gondii; Leishmania mexicana, L. tropica, L. major, L. aethiopica, L. donovani, Trypanosoma cruzi, T brucei, Schistosoma mansoni, S. haematobium, S. japonium; Trichinella spiralis; Wuchereria bancrofti; Brugia malayli; Entaroeba histolytica; Enterobius vermiculoarus; Taenia solium, T. saginata, Trichomonas vaginatis, T. hominis, T. tenax; Giardia lamblia; Cryptosporidium parvum; Pneumocytis carinii, Babesia bovis, B. divergens, B. microti, Isospora belli, L. hominis; Dientamoeba fragilis; Onchocerca volvulus; Ascaris lumbricoides; Necator americanis; Ancylostoma duodenale; Strongyloides stercoralis; Capillaria philippinensis; Angiostrongylus cantonensis; Hymenolepis nana; Diphyllobothrium latum; Echinococcus granulosus, E. multilocularis; Paragonimus westermani, P. caliensis; Chlonorchis sinensis; Opisthorchisfelineas, G. Viverini, Fasciola hepatica, Sarcoptes scabiei, Pediculus humanus; Phthirlus pubis*; and *Dermatobia hominis*, as well as any other parasite now known or later identified to be pathogenic.

5.4.2 Insertion of the Heterologous Gene Sequence

Insertion of a foreign gene sequence into a viral vector of the invention can be accomplished by either a complete replacement of a viral coding region with a heterologous sequence or by a partial replacement or by adding the heterologous nucleotide sequence to the viral genome. Complete replacement would probably best be accomplished through the use of PCR-directed mutagenesis. Briefly, PCR-primer A would contain, from the 5' to 3' end: a unique restriction enzyme site, such as a class IIS restriction enzyme site (i.e., a "shifter" enzyme; that recognizes a specific sequence but cleaves the DNA either upstream or downstream of that sequence); a stretch of nucleotides complementary to a region of the gene that is to be replaced; and a stretch of nucleotides complementary to the carboxy-terminus coding portion of the heterologous sequence. PCR-primer B would contain from the 5' to 3' end: a unique restriction enzyme site; a stretch of nucleotides complementary to the gene that is to be replaced; and a stretch of nucleotides corresponding to the 5' coding portion of the heterologous or non-native gene. After a PCR reaction using these primers with a cloned copy of the heterologous or non-native gene, the product may be excised and cloned using the unique restriction sites. Digestion with the class IIS enzyme and transcription with the purified phage polymerase would generate a RNA molecule containing the exact untranslated ends of the viral gene that carries now a heterologous or non-native gene insertion. In an alternate embodiment, PCR-primed reactions could be used to prepare double-stranded DNA containing the bacteriophage promoter sequence, and the hybrid gene sequence so that RNA templates can be transcribed directly without cloning.

A heterologous nucleotide sequence can be added or inserted at various positions of the virus of the invention. In one embodiment, the heterologous nucleotide sequence is added or inserted at position 1. In another embodiment, the heterologous nucleotide sequence is added or inserted at position 2. In another embodiment, the heterologous nucleotide sequence is added or inserted at position 3. In another embodiment, the heterologous nucleotide sequence is added or inserted at position 4. In another embodiment, the heterologous nucleotide sequence is added or inserted at position 5. In yet another embodiment, the heterologous nucleotide sequence is added or inserted at position 6. As used herein, the term "position" refers to the position of the heterologous nucleotide sequence on the viral genome to be transcribed, e.g., position 1 means that it is the first gene to be transcribed, and position 2 means that it is the second gene to be transcribed. Inserting heterologous nucleotide sequences at the lower-numbered positions of the virus generally results in stronger expression of the heterologous nucleotide sequence compared to insertion at higher-numbered positions due to a transcriptional gradient that occurs across the genome of the virus. However, the transcriptional gradient also yields specific ratios of viral mRNAs. Insertion of foreign genes will perturb these ratios and result in the synthesis of different amounts of viral proteins that may influence virus replication. Thus, both the transcriptional gradient and the replication kinetics must be considered when choosing an insertion site. Inserting heterologous nucleotide sequences at lower-numbered positions is the preferred embodiment of the invention if strong expression of the heterologous nucleotide sequence is desired. In a preferred embodiment, the heterologous sequence is added or inserted at position 1, 2 or 3.

When inserting a heterologous nucleotide sequence into the virus of the invention, the intergenic region between the end of the coding sequence of the heterologous gene and the start of the coding sequence of the downstream gene can be altered to achieve a desired effect. As used herein, the term "intergenic region" refers to nucleotide sequence between the stop signal of one gene and the start codon (e.g., AUG) of the coding sequence of the next downstream open reading frame. An intergenic region may comprise a non-coding region of a gene, i.e., between the transcription start site and the start of the coding sequence (AUG) of the gene. This non-coding region occurs naturally in some viral genes.

In various embodiments, the intergenic region between the heterologous nucleotide sequence and the downstream gene can be engineered, independently from each other, to be at least 10 nt in length, at least 20 nt in length, at least 30 nt in length, at least 50 nt in length, at least 75 nt in length, at least 100 nt in length, at least 125 nt in length, at least 150 nt in length, at least 175 nt in length or at least 200 nt in length. In certain embodiments, the intergenic region between the heterologous nucleotide sequence and the downstream gene can be engineered, independently from each other, to be at most 10 nt in length, at most 20 nt in length, at most 30 nt in length, at most 50 nt in length, at most 75 nt in length, at most 100 nt in length, at most 125 nt in length, at most 150 nt in length, at most 175 nt in length or at most 200 nt in length. In various embodiments, the non-coding region of a desired gene in a virus genome can also be engineered, independently from each other, to be at least 10 nt in length, at least 20 nt in length, at least 30 nt in length, at least 50 nt in length, at least 75 nt in length, at least 100 nt in length, at least 125 nt in length, at least 150 nt in length, at least 175 nt in length or at least 200 nt in length. In certain embodiments, the non-coding region of a desired gene in a virus genome can also be engineered, independently from each other, to be at most 10 nt in length, at most 20 nt in length, at most 30 nt in length, at most 50 nt in length, at most 75 nt in length, at most 100 nt in length, at most 125 nt in length, at most 150 nt in length, at most 175 nt in length or at most 200 nt in length.

When inserting a heterologous nucleotide sequence, the positional effect and the intergenic region manipulation can be used in combination to achieve a desirable effect. For example, the heterologous nucleotide sequence can be added or inserted at a position selected from the group consisting of position 1, 2, 3, 4, 5, and 6, and the intergenic region between the heterologous nucleotide sequence and the next downstream gene can be altered (see Table 3). Some of the combinations encompassed by the present invention are shown by way of example in Table 3.

TABLE 3

Examples of mode of insertion of heterologous nucleotide sequences

| | Position 1 | Position 2 | Position 3 | Position 4 | Position 5 | Position 6 |
|---|---|---|---|---|---|---|
| IGR[a] | 10-20 | 10-20 | 10-20 | 10-20 | 10-20 | 10-20 |
| IGR | 21-40 | 21-40 | 21-40 | 21-40 | 21-40 | 21-40 |
| IGR | 41-60 | 41-60 | 41-60 | 41-60 | 41-60 | 41-60 |
| IGR | 61-80 | 61-80 | 61-80 | 61-80 | 61-80 | 61-80 |
| IGR | 81-100 | 81-100 | 81-100 | 81-100 | 81-100 | 81-100 |
| IGR | 101-120 | 101-120 | 101-120 | 101-120 | 101-120 | 101-120 |
| IGR | 121-140 | 121-140 | 121-140 | 121-140 | 121-140 | 121-140 |
| IGR | 141-160 | 141-160 | 141-160 | 141-160 | 141-160 | 141-160 |
| IGR | 161-180 | 161-180 | 161-180 | 161-180 | 161-180 | 161-180 |
| IGR | 181-200 | 181-200 | 181-200 | 181-200 | 181-200 | 181-200 |
| IGR | 201-220 | 201-220 | 201-220 | 201-220 | 201-220 | 201-220 |
| IGR | 221-240 | 221-240 | 221-240 | 221-240 | 221-240 | 221-240 |
| IGR | 241-260 | 241-260 | 241-260 | 241-260 | 241-260 | 241-260 |
| IGR | 261-280 | 261-280 | 261-280 | 261-280 | 261-280 | 261-280 |
| IGR | 281-300 | 281-300 | 281-300 | 281-300 | 281-300 | 281-300 |

[a]Intergenic Region, measured in nucleotide.

Depending on the purpose (e.g., to have strong immunogenicity) of the inserted heterologous nucleotide sequence, the position of the insertion and the length of the intergenic region of the inserted heterologous nucleotide sequence can be determined by various indexes including, but not limited to, replication kinetics and protein or mRNA expression levels, measured by following non-limiting examples of assays: plaque assay, fluorescent-focus assay, infectious center assay, transformation assay, endpoint dilution assay, efficiency of plating, electron microscopy, hemagglutination, measurement of viral enzyme activity, viral neutralization, hemagglutination inhibition, complement fixation, immunostaining, immunoprecipitation and immunoblotting, enzyme-linked immunosorbent assay, nucleic acid detection (e.g., Southern blot analysis, Northern blot analysis, Western blot analysis), growth curve, employment of a reporter gene (e.g., using a reporter gene, such as Green Fluorescence Protein (GFP) or enhanced Green Fluorescence Protein (eGFP), integrated to the viral genome the same fashion as the interested heterologous gene to observe the protein expression), or a combination thereof. Procedures of performing these assays are well known in the art (see, e.g., Flint et al., PRINCIPLES OF VIROLOGY, MOLECULAR BIOLOGY, PATHOGENESIS, AND CONTROL, 2000, ASM Press pp 25-56, the entire text is incorporated herein by reference), and non-limiting examples are given in the Example sections, infra.

For example, expression levels can be determined by infecting cells in culture with a virus of the invention and subsequently measuring the level of protein expression by, e.g., Western blot analysis or ELISA using antibodies specific to the gene product of the heterologous sequence, or measuring the level of RNA expression by, e.g., Northern blot analysis using probes specific to the heterologous sequence. Similarly, expression levels of the heterologous sequence can be determined by infecting an animal model and measuring the level of protein expressed from the heterologous sequence of the recombinant virus of the invention in the animal model. The protein level can be measured by obtaining a tissue sample from the infected animal and then subjecting the tissue sample to Western blot analysis or ELISA, using antibodies specific to the gene product of the heterologous sequence. Further, if an animal model is used, the titer of antibodies produced by the animal against the gene product of the heterologous sequence can be determined by any technique known to the skilled artisan, including but not limited to, ELISA.

As the heterologous sequences can be homologous to a nucleotide sequence in the genome of the virus, care should be taken that the probes and the antibodies are indeed specific to the heterologous sequence or its gene product.

In certain specific embodiments, expression levels of F-protein of hMPV from chimeric avian-human *metapneumovirus* can be determined by any technique known to the skilled artisan. Expression levels of the F-protein can be determined by infecting cells in a culture with the chimeric virus of the invention and measuring the level of protein expression by, e.g., Western blot analysis or ELISA using antibodies specific to the F-protein and/or the G-protein of hMPV, or measuring the level of RNA expression by, e.g., Northern blot analysis using probes specific to the F-gene and/or the G-gene of human *metapneumovirus*. Similarly, expression levels of the heterologous sequence can be determined using an animal model by infecting an animal and measuring the level of F-protein and/or G-protein in the animal model. The protein level can be measured by obtaining a tissue sample from the infected animal and then subjecting the tissue sample to Western blot analysis or ELISA using antibodies specific to F-protein and/or G-protein of the heterologous sequence. Further, if an animal model is used, the titer of antibodies produced by the animal against F-protein and/or G-protein can be detenmined by any technique known to the skilled artisan, including but not limited to, ELISA.

The rate of replication of a recombinant virus of the invention can be determined by any technique known to the skilled artisan.

In certain embodiments, to facilitate the identification of the optimal position of the heterologous sequence in the viral genome and the optimal length of the intergenic region, the heterologous sequence encodes a reporter gene. Once the optimal parameters are detenmined, the reporter gene is replaced by a heterologous nucleotide sequence encoding an antigen of choice. Any reporter gene known to the skilled artisan can be used with the methods of the invention. For more detail, see section 5.8.

The rate of replication of the recombinant virus can be determined by any standard technique known to the skilled artisan. The rate of replication is represented by the growth rate of the virus and can be determined by plotting the viral titer over the time post infection. The viral titer can be measured by any technique known to the skilled artisan. In certain embodiments, a suspension containing the virus is incubated with cells that are susceptible to infection by the virus. Cell types that can be used with the methods of the invention include, but are not limited to, Vero cells, LLC-MK-2 cells, Hep-2 cells, LF 1043 (HEL) cells, MRC-5 cells, WI-38 cells, tMK cells, 293 T cells, QT 6 cells, QT 35 cells, or chicken embryo fibroblasts (CEF). Subsequent to the incubation of the virus with the cells, the number of infected cells is detenmined. In certain specific embodiments, the virus comprises a reporter gene. Thus, the number of cells expressing the reporter gene is representative of the number of infected cells. In a specific embodiment, the virus comprises a heterologous nucleotide sequence encoding for eGFP, and the number of cells expressing eGFP, i.e., the number of cells infected with the virus, is determined using FACS.

In certain embodiments, the replication rate of the recombinant virus of the invention is at most 20% of the replication rate of the wild type virus from which the recombinant virus is derived under the same conditions. The same conditions refer to the same initial titer of virus, the same strain of cells, the same incubation temperature, growth medium, number of cells and other test conditions that may affect the replication rate. For example, the replication rate of APV/hMPV with PIV's F gene in position 1 is at most 20% of the replication rate of APV.

In certain embodiments, the replication rate of the recombinant virus of the invention is at most 5%, at most 10%, at most 20%, at most 30%, at most 40%, at most 50%, at most 75%, at most 80%, at most 90% of the replication rate of the wild type virus from which the recombinant virus is derived under the same conditions. In certain embodiments, the replication rate of the recombinant virus of the invention is at least 5%, at least 10%, at least 20%, at least 30%, at least 40%, at least 50%, at least 75%, at least 80%, at least 90% of the replication rate of the wild type virus from which the recombinant virus is derived under the same conditions. In certain embodiments, the replication rate of the recombinant virus of the invention is between 5% and 20%, between 10% and 40%, between 25% and 50%, between 40% and 75%, between 50% and 80%, or between 75% and 90% of the replication rate of the wild type virus from which the recombinant virus is derived under the same conditions.

In certain embodiments, the expression level of the heterologous sequence in the recombinant virus of the invention is at most 20% of the expression level of the F-protein of the wild type virus from which the recombinant virus is derived under the same conditions. The same conditions refer to the same initial titer of virus, the same strain of cells, the same incubation temperature, growth medium, number of cells and other test conditions that may affect the replication rate. For example, the expression level of the heterologous sequence of the F-protein of PIV3 in position 1 of hMPV is at most 20% of the expression level of the F-protein of hMPV.

In certain embodiments, the expression level of the heterologous sequence in the recombinant virus of the invention is at most 5%, at most 10%, at most 20%, at most 30%, at most 40%, at most 50%, at most 75%, at most 80%, at most 90% of the expression level of the F-protein of the wild type virus from which the recombinant virus is derived under the same conditions. In certain embodiments, the expression level of the heterologous sequence in the recombinant virus of the invention is at least 5%, at least 10%, at least 20%, at least 30%, at least 40%, at least 50%, at least 75%, at least 80%, at least 90% of the expression level of the F-protein of the wild type virus from which the recombinant virus is derived under the same conditions. In certain embodiments, the expression level of the heterologous sequence in the recombinant virus of the invention is between 5% and 20%, between 10% and 40%, between 25% and 50%, between 40% and 75%, between 50% and 80%, or between 75% and 90% of the expression level of the F-protein of the wild type virus from which the recombinant virus is derived under the same conditions.

5.4.3 Insertion of the Heterologous Gene Sequence into the G Gene

The G protein is a transmembrane protein of metapneumoviruses. In a specific embodiment, the heterologous sequence is inserted into the region of the G-ORF that encodes for the ectodomain, such that it is expressed on the surface of the viral envelope. In one approach, the heterologous sequence may be inserted within the antigenic site without deleting any viral sequences. In another approach, the heterologous sequences replaces sequences of the G-ORF. Expression products of such constructs may be useful in vaccines against the foreign antigen, and may indeed circumvent problems associated with propagation of the recombinant virus in the vaccinated host. An intact G molecule with a substitution only in antigenic sites may allow for G function and thus allow for the construction of a viable virus. Therefore, this virus can be grown without the need for additional helper functions. The virus may also be attenuated in other ways to avoid any danger of accidental escape.

Other hybrid constructions may be made to express proteins on the cell surface or enable them to be released from the cell.

5.4.4 Construction of Bicistronic RNA

Bicistronic mRNA could be constructed to permit internal initiation of translation of viral sequences and allow for the expression of foreign protein coding sequences from the regular terminal initiation site. Alternatively, a bicistronic mRNA sequence may be constructed wherein the viral sequence is translated from the regular terminal open reading frame, while the foreign sequence is initiated from an internal site. Certain internal ribosome entry site (IRES) sequences may be utilized. The IRES sequences which are chosen should be short enough to not interfere with MPV packaging limitations. Thus, it is preferable that the IRES chosen for such a bicistronic approach be no more than 500 nucleotides in length. In a specific embodiment, the IRES is derived from a picornavirus and does not include any additional picornaviral sequences. Specific IRES elements include, but are not limited to the mammalian BiP IRES and the hepatitis C virus IRES.

Alternatively, a foreign protein may be expressed from a new internal transcriptional unit in which the transcriptional unit has an initiation site and polyadenylation site. In another embodiment, the foreign gene is inserted into a MPV gene such that the resulting expressed protein is a fusion protein.

5.5 Expression of Heterologous Gene Products Using Recombinant cDNA and RNA Templates The viral vectors and recombinant templates prepared as described above can be used in a variety of ways to express the heterologous gene products in appropriate host cells or to create chimeric viruses that express the heterologous gene products. In one embodiment, the recombinant cDNA can be used to transfect appropriate host cells and the resulting RNA may direct the expression of the heterologous gene product at high levels. Host cell systems which provide for high levels of expression include continuous cell lines that supply viral functions such as cell lines superinfected with APV or MPV, respectively, cell lines engineered to complement APV or MPV functions, etc.

In an alternate embodiment of the invention, the recombinant templates may be used to transfect cell lines that express a viral polymerase protein in order to achieve expression of the heterologous gene product. To this end, transformed cell lines that express a polymerase protein such as the L protein may be utilized as appropriate host cells. Host cells may be similarly engineered to provide other viral functions or additional functions such as G or N.

In another embodiment, a helper virus may provide the RNA polymerase protein utilized by the cells in order to achieve expression of the heterologous gene product. In yet another embodiment, cells may be transfected with vectors encoding viral proteins such as the N, P, L, and M2-1 proteins.

5.6 Rescue of Recombinant Virus Particles

In order to prepare the chimeric and recombinant viruses of the invention, a cDNA encoding the genome of a recombinant or chimeric virus of the invention in the plus or minus sense may be used to transfect cells which provide viral proteins and functions required for replication and rescue. Alternatively, cells may be transfected with helper virus before, during, or after transfection by the DNA or RNA molecule coding for the recombinant virus of the invention. The synthetic recombinant plasmid DNAs and RNAs of the invention can be replicated and rescued into infectious virus particles by any number of techniques known in the art, as described, e.g., in U.S. Pat. No. 5,166,057 issued Nov. 24, 1992; in U.S. Pat. No. 5,854,037 issued Dec. 29, 1998; in European Patent Publication EP 0702085A1, published Feb. 20, 1996; in U.S. patent application Ser. No. 09/152,845; in International Patent Publications PCT WO97/12032 published Apr. 3, 1997; WO96/34625 published Nov. 7, 1996; in European Patent Publication EP-A780475; WO 99/02657 published Jan. 21, 1999; WO 98/53078 published Nov. 26, 1998; WO 98/02530 published Jan. 22, 1998; WO 99/15672 published Apr. 1, 1999; WO 98/13501 published Apr. 2, 1998; WO 97/06270 published Feb. 20, 1997; and EPO 78047SA1 published Jun. 25, 1997, each of which is incorporated by reference herein in its entirety.

In one embodiment, of the present invention, synthetic recombinant viral RNAs may be prepared that contain the non-coding regions of the negative strand virus RNA which are essential for the recognition by viral polymerases and for packaging signals necessary to generate a mature virion. There are a number of different approaches which may be used to apply the reverse genetics approach to rescue negative strand RNA viruses. First, the recombinant RNAs are synthesized from a recombinant DNA template and reconstituted in vitro with purified viral polymerase complex to form recombinant ribonucleoproteins (RNPs) which can be used to transfect cells. In another approach, a more efficient transfection is achieved if the viral polymerase proteins are present during transcription of the synthetic RNAs either in vitro or in vivo. With this approach the synthetic RNAs may be transcribed from cDNA plasmids which are either co-transcribed in vitro with cDNA plasmids encoding the polymerase proteins, or transcribed in vivo in the presence of polymerase proteins, i.e., in cells which transiently or constitutively express the polymerase proteins.

In additional approaches described herein, the production of infectious chimeric or recombinant virus may be replicated in host cell systems that express a metapneumoviral polymerase protein (e.g., in virus/host cell expression systems; transformed cell lines engineered to express a polymerase protein, etc.), so that infectious chimeric or recombinant virus are rescued. In this instance, helper virus need not be utilized since this function is provided by the viral polymerase proteins expressed.

In accordance with the present invention, any technique known to those of skill in the art may be used to achieve replication and rescue of recombinant and chimeric viruses. One approach involves supplying viral proteins and functions required for replication in vitro prior to transfecting host cells. In such an embodiment, viral proteins may be supplied in the form of wildtype virus, helper virus, purified viral proteins or recombinantly expressed viral proteins. The viral proteins may be supplied prior to, during or post transcription of the synthetic cDNAs or RNAs encoding the chimeric virus. The entire mixture may be used to transfect host cells. In another approach, viral proteins and functions required for replication may be supplied prior to or during transcription of the synthetic cDNAs or RNAs encoding the chimeric virus. In such an embodiment, viral proteins and functions required for replication are supplied in the form of wildtype virus, helper virus, viral extracts, synthetic cDNAs or RNAs which express the viral proteins are introduced into the host cell via infection or transfection. This infection/transfection takes place prior to or simultaneous to the introduction of the synthetic cDNAs or RNAs encoding the chimeric virus.

In a particularly desirable approach, cells engineered to express all viral genes or chimeric or recombinant virus of the invention, i.e., APV, MPV, MPV/APV or APV/MPV, may result in the production of infectious virus which contain the desired genotype; thus eliminating the need for a selection system. Theoretically, one can replace any one of the ORFs or part of any one of the ORFs encoding structural proteins of MPV with a foreign sequence. However, a necessary part of this equation is the ability to propagate the defective virus (defective because a normal viral gene product is missing or altered). A number of possible approaches exist to circumvent this problem. In one approach a virus having a mutant protein can be grown in cell lines which are constructed to constitutively express the wild type version of the same protein. By this way, the cell line complements the mutation in the virus. Similar techniques may be used to construct transformed cell lines that constitutively express any of the MPV genes. These cell lines which are made to express the viral protein may be used to complement the defect in the chimeric or recombinant virus and thereby propagate it. Alternatively, certain natural host range systems may be available to propagate chimeric or recombinant virus.

In yet another embodiment, viral proteins and functions required for replication may be supplied as genetic material in the form of synthetic cDNAs or RNAs so that they are co-transcribed with the synthetic cDNAs or RNAs encoding the chimeric virus. In a particularly desirable approach, plasmids which express the chimeric virus and the viral polymerase and/or other viral functions are co-transfected into host cells. For example, plasmids encoding the genomic or antigenomic APV, MPV, MPV/APV or APV/MPV RNA, with or without one or more heterologous sequences, may be co-transfected into host cells with plasmids encoding the metapneumoviral polymerase proteins N, P, L, or M2-1. Alternatively, rescue of the recombinant viruses of the invention may be accomplished by the use of Modified Vaccinia Virus Ankara (MVA) encoding T7 RNA polymerase, or a combination of MVA and plasmids encoding the polymerase proteins (N, P, and L). For example, MVA-T7 or Fowl Pox-T7 can be infected into Vero cells, LLC-MK-2 cells, Hep-2 cells, LF 1043 (HEL) cells, tMK cells, LLC-MK2, HUT 292, FRHL-2 (rhesus), FCL-1 (green monkey), WI-38 (human), MRC-5 (human) cells, 293 T cells, QT 6 cells, QT 35 cells and CEF cells. After infection with MVA-T7 or Fowl Pox-T7, a full length antigenomic cDNA encoding the recombinant virus of the invention may be transfected into the cells together with the N, P, L, and M2-1 encoding expression plasmids. Alternatively, the polymerase may be provided by plasmid transfection. The cells and cell supernatant can subsequently be harvested and subjected to a single freeze-thaw cycle. The resulting cell lysate may then be used to infect a fresh HeLa or Vero cell monolayer in the presence of 1-beta-D-arabinofuranosylcytosine (ara C), a replication inhibitor of vaccinia virus, to generate a virus stock. The supernatant and cells from these plates can then be harvested, freeze-thawed once and the presence of recombinant virus particles of the invention can be assayed by immunostaining of virus plaques using antiserum specific to the particular virus.

Another approach to propagating the chimeric or recombinant virus may involve co-cultivation with wild-type virus. This could be done by simply taking recombinant virus and co-infecting cells with this and another wild-type virus. The wild-type virus should complement for the defective virus gene product and allow growth of both the wild-type and recombinant virus. Alternatively, a helper virus may be used to support propagation of the recombinant virus.

In another approach, synthetic templates may be replicated in cells co-infected with recombinant viruses that express the *metapneumovirus* polymerase protein. In fact, this method may be used to rescue recombinant infectious virus in accordance with the invention. To this end, the *metapneumovirus* polymerase protein may be expressed in any expression vector/host cell system, including but not limited to viral expression vectors (e.g., vaccinia virus, adenovirus, baculovirus, etc.) or cell lines that express a polymerase protein (e.g., see Krystal et al, 1986, Proc. Natl. Acad. Sci. USA 83: 2709-2713). Moreover, infection of host cells expressing all *metapneumovirus* proteins may result in the production of infectious chimeric virus particles. It should be noted that it may be possible to construct a recombinant virus without altering virus viability. These altered viruses would then be growth competent and would not need helper functions to replicate.

Transfection procedures are well-known to the skill artisan and include, but are not limited to, DEAE-dextran-mediated, Calcium phosphate-mediated, Electroporation, and Liposome-mediated transfection.

A full-length viral genome can be assembled from several smaller PCR fragments. Restriction maps of different isolates of hMPV are shown in FIG. 28. The restriction sites can be used to assemble the full-length construct. In certain embodiments, PCR primers are designed such that the fragment resulting from the PCR reaction has a restriction site close to its 5' end and a restriction site close to it 3' end. The PCR product can then be digested with the respective restriction enzymes and subsequently ligated to the neighboring PCR fragments.

5.7 Attenuation of Recombinant Viruses

The recombinant viruses of the invention can be further genetically engineered to exhibit an attenuated phenotype. In particular, the recombinant viruses of the invention exhibit an attenuated phenotype in a subject to which the virus is administered as a vaccine. Attenuation can be achieved by any method known to a skilled artisan. Without being bound by theory, the attenuated phenotype of the recombinant virus can be caused, e.g., by using a virus that naturally does not replicate well in an intended host (e.g., using an APV in human), by reduced replication of the viral genome, by reduced ability of the virus to infect a host cell, or by reduced ability of the viral proteins to assemble to an infectious viral particle relative to the wild type strain of the virus. The viability of certain sequences of the virus, such as the leader and the trailer sequence can be tested using a minigenome assay (see section 5.8).

The attenuated phenotypes of a recombinant virus of the invention can be tested by any method known to the artisan (see, e.g., section 5.8). A candidate virus can, for example, be tested for its ability to infect a host or for the rate of replication in a cell culture system. In certain embodiments, a minigenome system is used to test the attenuated virus when the gene that is altered is N, P, L, M2, F, G, M2-1, M2-2 or a combination thereof. In certain embodiments, growth curves at different temperatures are used to test the attenuated phenotype of the virus. For example, an attenuated virus is able to grow at 35° C., but not at 39° C. or 40° C. In certain embodiments, different cell lines can be used to evaluate the attenuated phenotype of the virus. For example, an attenuated virus may only be able to grow in monkey cell lines but not the human cell lines, or the achievable virus titers in different cell lines are different for the attenuated virus. In certain embodiments, viral replication in the respiratory tract of a small animal model, including but not limited to, hamsters, cotton rats, mice and guinea pigs, is used to evaluate the attenuated phenotypes of the virus. In other embodiments, the immune response induced by the virus, including but not limited to, the antibody titers (e.g., assayed by plaque reduction neutralization assay or ELISA) is used to evaluate the attenuated phenotypes of the virus. In a specific embodiment, the plaque reduction neutralization assay or ELISA is carried out at a low dose. In certain embodiments, the ability of the recombinant virus to elicit pathological symptoms in an animal model can be tested. A reduced ability of the virus to elicit pathological symptoms in an animal model system is indicative of its attenuated phenotype. In a specific embodiment, the candidate viruses are tested in a monkey model for nasal infection, indicated by mucous production.

The viruses of the invention can be attenuated such that one or more of the functional characteristics of the virus are impaired. In certain embodiments, attenuation is measured in comparison to the wild type strain of the virus from which the attenuated virus is derived. In other embodiments, attenuation is determined by comparing the growth of an attenuated virus in different host systems. Thus, for a non-limiting example, an APV is said to be attenuated when grown in a human host if the growth of the APV in the human host is reduced compared to the growth of the APV in an avian host.

In certain embodiments, the attenuated virus of the invention is capable of infecting a host, is capable of replicating in a host such that infectious viral particles are produced. In comparison to the wild type strain, however, the attenuated strain grows to lower titers or grows more slowly. Any technique known to the skilled artisan can be used to determine the growth curve of the attenuated virus and compare it to the growth curve of the wild type virus. For exemplary methods see Example section, infra. In a specific embodiment, the attenuated virus grows to a titer of less than $10^5$ pfu/ml, of less than $10^4$ pfu/ml, of less than $10^3$ pfu/ml, or of less than $10^2$ pfu/ml in Vero cells under conditions as described in, e.g., Example 22.

In certain embodiments, the attenuated virus of the invention (e.g., a chimeric mammalian MPV) cannot replicate in human cells as well as the wild type virus (e.g., wild type mammalian MPV) does. However, the attenuated virus can replicate well in a cell line that lack interferon functions, such as Vero cells.

In other embodiments, the attenuated virus of the invention is capable of infecting a host, of replicating in the host, and of causing proteins of the virus of the invention to be inserted into the cytoplasmic membrane, but the attenuated virus does not cause the host to produce new infectious viral particles. In certain embodiments, the attenuated virus infects the host, replicates in the host, and causes viral proteins to be inserted in the cytoplasmic membrane of the host with the same efficiency as the wild type mammalian virus. In other embodiments, the ability of the attenuated virus to cause viral proteins to be inserted into the cytoplasmic membrane into the host cell is reduced compared to the wild type virus. In certain embodiments, the ability of the attenuated mammalian virus to replicate in the host is reduced compared to the wild type virus. Any technique known to the skilled artisan can be used to determine whether a virus is capable of infecting a mammalian cell, of replicating within the host, and of causing viral proteins to be inserted into the cytoplasmic membrane of the host. For illustrative methods see section 5.8.

In certain embodiments, the attenuated virus of the invention is capable of infecting a host. In contrast to the wild type mammalian MPV, however, the attenuated mammalian MPV cannot be replicated in the host. In a specific embodiment, the attenuated mammalian virus can infect a host and can cause the host to insert viral proteins in its cytoplasmic membranes, but the attenuated virus is incapable of being replicated in the host. Any method known to the skilled artisan can be used to test whether the attenuated mammalian MPV has infected the host and has caused the host to insert viral proteins in its cytoplasmic membranes.

In certain embodiments, the ability of the attenuated mammalian virus to infect a host is reduced compared to the ability of the wild type virus to infect the same host. Any technique known to the skilled artisan can be used to determine whether a virus is capable of infecting a host. For illustrative methods see section 5.8.

In certain embodiments, mutations (e.g., missense mutations) are introduced into the genome of the virus to generated a virus with an attenuated phenotype. Mutations (e.g., missense mutations) can be introduced into the N-gene, the P-gene, the M-gene, the F-gene, the M2-gene, the SH-gene, the G-gene or the L-gene of the recombinant virus. Mutations can be additions, substitutions, deletions, or combinations thereof. In specific embodiments, a single amino acid deletion mutation for the N, P, L, F, G, M2-1, M2-2 or M2 proteins is introduced, which can be screened for functionality in the mini-genome assay system and be evaluated for predicted functionality in the virus. In more specific embodiments, the missense mutation is a cold-sensitive mutation. In other embodiments, the missense mutation is a heat-sensitive mutation. In one embodiment, major phosphorylation sites of P protein of the virus is removed. In another embodiment, a mutation or mutations are introduced into the L gene of the virus to generate a temperature sensitive strain. In yet another embodiment, the cleavage site of the F gene is mutated in such a way that cleavage does not occur or occurs at very low efficiency.

In other embodiments, deletions are introduced into the genome of the recombinant virus. In more specific embodiments, a deletion can be introduced into the N-gene, the P-gene, the M-gene, the F-gene, the M2-gene, the SH-gene, the G-gene or the L-gene of the recombinant virus. In specific embodiments, the deletion is in the M2-gene of the recombinant virus of the present invention. In other specific embodiments, the deletion is in the SH-gene of the recombinant virus of the present invention. In yet another specific embodiment, both the M2-gene and the SH-gene are deleted.

In certain embodiments, the intergenic region of the recombinant virus is altered. In one embodiment, the length of the intergenic region is altered. In another embodiment, the intergenic regions are shuffled from 5' to 3' end of the viral genome.

In other embodiments, the genome position of a gene or genes of the recombinant virus is changed. In one embodiment, the F or G gene is moved to the 3' end of the genome. In another embodiment, the N gene is moved to the 5' end of the genome.

In certain embodiments, attenuation of the virus is achieved by replacing a gene of the wild type virus with a gene of a virus of a different species, of a different subgroup, or of a different variant. In illustrative embodiments, the N-gene, the P-gene, the M-gene, the F-gene, the M2-gene, the SH-gene, the G-gene or the L-gene of a mammalian MPV is replaced with the N-gene, the P-gene, the M-gene, the F-gene, the M2-gene, the SH-gene, the G-gene or the L-gene, respectively, of an APV. In other illustrative embodiments, the N-gene, the P-gene, the M-gene, the F-gene, the M2-gene, the SH-gene, the G-gene or the L-gene of APV is replaced with the N-gene, the P-gene, the M-gene, the F-gene, the M2-gene, the SH-gene, the G-gene or the L-gene, respectively, of a mammalian MPV. In a preferred embodiment, attenuation of the virus is achieved by replacing one or more polymerase associated genes (e.g., N, P, L or M2) with genes of a virus of a different species.

In certain embodiments, attenuation of the virus is achieved by replacing one or more specific domains of a protein of the wild type virus with domains derived from the corresponding protein of a virus of a different species. In an illustrative embodiment, the ectodomain of a F protein of APV is replaced with an ectodomain of a F protein of a mammalian MPV. In a preferred embodiment, one or more specific domains of L, N, or P protein are replaced with domains derived from corresponding proteins of a virus of a different species. In certain other embodiments, attenuation of the virus is achieved by deleting one or more specific domains of a protein of the wild type virus. In a specific embodiment, the transmembrane domain of the F-protein is deleted.

In certain embodiments of the invention, the leader and/or trailer sequence of the recombinant virus of the invention can be modified to achieve an attenuated phenotype. In certain, more specific embodiments, the leader and/or trailer sequence is reduced in length relative to the wild type virus by at least 1 nucleotide, at least 2 nucleotides, at least 3 nucleotides, at least 4 nucleotides, at least 5 nucleotides or at least 6 nucleotides. In certain other, more specific embodiments, the sequence of the leader and/or trailer of the recombinant virus is mutated. In a specific embodiment, the leader and the trailer sequence are 100% complementary to each other. In other embodiments, 1 nucleotide, 2 nucleotides, 3 nucleotides, 4 nucleotides, 5 nucleotides, 6 nucleotides, 7 nucleotides, 8 nucleotides, 9 nucleotides, or 10 nucleotides are not complementary to each other where the remaining nucleotides of the leader and the trailer sequences are complementary to each other. In certain embodiments, the non-complementary nucleotides are identical to each other. In certain other embodiments, the non-complementary nucleotides are different from each other. In other embodiments, if the non-complementary nucleotide in the trailer is purine, the corresponding nucleotide in the leader sequence is also a purine. In other embodiments, if the non-complementary nucleotide in the trailer is pyrimidine, the corresponding nucleotide in the leader sequence is also a purine.

When a live attenuated vaccine is used, its safety must also be considered. The vaccine must not cause disease. Any techniques known in the art that can make a vaccine safe may be used in the present invention. In addition to attenuation techniques, other techniques may be used. One non-limiting example is to use a soluble heterologous gene that cannot be incorporated into the virion membrane. For example, a single copy of the soluble RSV F gene, a version of the RSV gene lacking the transmembrane and cytosolic domains, can be used. Since it cannot be incorporated into the virion membrane, the virus tropism is not expected to change.

Various assays can be used to test the safety of a vaccine. See section 5.8, infra. Particularly, sucrose gradients and neutralization assays can be used to test the safety. A sucrose gradient assay can be used to determine whether a heterologous protein is inserted in a virion. If the heterologous protein is inserted in the virion, the virion should be tested for its ability to cause symptoms even if the parental strain does not cause symptoms. Without being bound by theory, if the heterologous protein is incorporated in the virion, the virus may have acquired new, possibly pathological, properties.

5.8 Assays for Use with the Invention

A number of assays may be employed in accordance with the present invention in order to determine the rate of growth of a chimeric or recombinant virus in a cell culture system, an animal model system or in a subject. A number of assays may also be employed in accordance with the present invention in order to determine the requirements of the chimeric and recombinant viruses to achieve infection, replication and packaging of virions.

The assays described herein may be used to assay viral titre over time to determine the growth characteristics of the virus. In a specific embodiment, the viral titre is determined by obtaining a sample from the infected cells or the infected subject, preparing a serial dilution of the sample and infecting a monolayer of cells that are susceptible to infection with the virus at a dilution of the virus that allows for the emergence of single plaques. The plaques can then be counted and the viral titre express as plaque forming units per milliliter of sample. In a specific embodiment of the invention, the growth rate of a virus of the invention in a subject is estimated by the titer of antibodies against the virus in the subject. Without being bound by theory, the antibody titer in the subject reflects not only the viral titer in the subject but also the antigenicity. If the antigenicity of the virus is constant, the increase of the antibody titer in the subject can be used to determine the growth curve of the virus in the subject. In a preferred embodiment, the growth rate of the virus in animals or humans is best tested by sampling biological fluids of a host at multiple time points post-infection and measuring viral titer.

The expression of heterologous gene sequence in a cell culture system or in a subject can be determined by any technique known to the skilled artisan. In certain embodiments, the expression of the heterologous gene is measured by quantifying the level of the transcript. The level of the transcript can be measured by Northern blot analysis or by RT-PCR using probes or primers, respectively, that are specific for the transcript. The transcript can be distinguished from the genome of the virus because the virus is in the antisense orientation whereas the transcript is in the sense orientation. In certain embodiments, the expression of the heterologous gene is measured by quantifying the level of the protein product of the heterologous gene. The level of the protein can be measured by Western blot analysis using antibodies that are specific to the protein.

In a specific embodiment, the heterologous gene is tagged with a peptide tag. The peptide tag can be detected using antibodies against the peptide tag. The level of peptide tag detected is representative for the level of protein expressed from the heterologous gene. Alternatively, the protein expressed from the heterologous gene can be isolated by virtue of the peptide tag. The amount of the purified protein correlates with the expression level of the heterologous gene. Such peptide tags and methods for the isolation of proteins fused to such a peptide tag are well known in the art. A variety of peptide tags known in the art may be used in the modification of the heterologous gene, such as, but not limited to, the immunoglobulin constant regions, polyhistidine sequence (Petty, 1996, Metal-chelate affinity chromatography, in Current Protocols in Molecular Biology, volume 1-3 (1994-1998). Ed. by Ausubel, F. M., Brent, R., Kunston, R. E., Moore, D. D., Seidman, J. G., Smith, J. A. and Struhl, K. Published by John Wiley and sons, Inc., USA, Greene Publish. Assoc. & Wiley Interscience), glutathione S-transferase (GST; Smith, 1993, Methods Mol. Cell Bio. 4:220-229), the *E. coli* maltose binding protein (Guan et al., 1987, Gene 67:21-30), various cellulose binding domains (U.S. Pat. Nos. 5,496,934; 5,202,247; 5,137,819; Tomme et al., 1994, Protein Eng. 7:117-123), and the FLAG epitope (Short Protocols in Molecular Biology, 1999, Ed. Ausubel et al., John Wiley & Sons, Inc., Unit 10.11) etc. Other peptide tags are recognized by specific binding partners and thus facilitate isolation by affinity binding to the binding partner, which is preferably immobilized and/or on a solid support. As will be appreciated by those skilled in the art, many methods can be used to obtain the coding region of the above-mentioned peptide tags, including but not limited to, DNA cloning, DNA amplification, and synthetic methods. Some of the peptide tags and reagents for their detection and isolation are available commercially.

Samples from a subject can be obtained by any method known to the skilled artisan. In certain embodiments, the sample consists of nasal aspirate, throat swab, sputum or broncho-alveolar lavage.

5.8.1 Minireplicon Constructs

Minireplicon constructs can be generated to contain an antisense reporter gene. Any reporter gene known to the skilled artisan can be used with the invention (see section 5.8.2). In a specific embodiment, the reporter gene is CAT. In certain embodiments, the reporter gene can be flanked by the negative-sense hMPV or APV leader linked to the hepatitis delta ribozyme (Hep-d Ribo) and T7 polymerase termination (T-T7) signals, and the hMPV or APV trailer sequence preceded by the T7 RNA polymerase promoter.

In certain embodiments, the plasmid encoding the minireplicon is transfected into a host cell. The host cell expresses T7 RNA polymerase, the N gene, the P gene, the L gene, and the M2.1 gene. In certain embodiments, the host cell is transfected with plasmids encoding T7 RNA polymerase, the N gene, the P gene, the L gene, and the M2.1 gene. In other embodiments, the plasmid encoding the minireplicon is transfected into a host cell and the host cell is infected with a helper virus.

The expression level of the reporter gene and/or its activity can be assayed by any method known to the skilled artisan, such as, but not limited to, the methods described in section 5.8.2.

In certain, more specific, embodiments, the minireplicon comprises the following elements, in the order listed: T7 RNA Polymerase or RNA polymerase I, leader sequence, gene start, GFP, trailer sequence, Hepatitis delta ribozyme sequence or RNA polymerase I termination sequence. If T7 is used as RNA polymerase, Hepatitis delta ribozyme sequence should be used as termination sequence. If RNA polymerase I is used, RNA polymerase I termination sequence may be used as a termination signal. Dependent on the rescue system, the sequence of the minireplicon can be in the sense or antisense orientation. In certain embodiments, the leader sequence can be modified relative to the wild type leader sequence of hMPV. The leader sequence can optionally be preceded by an AC. The T7 promoter sequence can be with or without a G-doublet or triplet, where the G-doublet or triplet provides for increased transcription.

In a specific embodiment, a cell is infected with hMPV at T0. 24 hours later, at T24, the cell is transfected with a minireplicon construct. 48 hours after T0 and 72 hours after T0, the cells are tested for the expression of the reporter gene. If a fluorescent reporter gene product is used (e.g., GFP), the expression of the reporter gene can be tested using FACS.

In another embodiment, a cell is transfected with six plasmids at T=0 hours. Cells are then harvested at T=40 hours and T=60 hours and analyzed for CAT or GFP expression. (See FIG. 25.)

In another specific embodiment, a cell is infected with MVA-T7 at T0. 1 hour later, at T1, the cell is transfected with a minireplicon construct. 24 hours after T0, the cell is infected with hMPV. 72 hours after T0, the cells are tested for the expression of the reporter gene. If a fluorescent reporter gene product is used (e.g., GFP), the expression of the reporter gene can be tested using FACS.

5.8.2 Reporter Genes

In certain embodiments, assays for measurement of reporter gene expression in tissue culture or in animal models can be used with the methods of the invention. The nucleotide sequence of the reporter gene is cloned into the virus, such as APV, hMPV, hMPV/APV or APV/hMPV, wherein (i) the position of the reporter gene is changed and (ii) the length of the intergenic regions flanking the reporter gene are varied. Different combinations are tested to determine the optimal rate of expression of the reporter gene and the optimal replication rate of the virus comprising the reporter gene.

In certain embodiments, minireplicon constructs are generated to include a reporter gene. The construction of minireplicon constructs is described herein.

The abundance of the reporter gene product can be determined by any technique known to the skilled artisan. Such techniques include, but are not limited to, Northern blot analysis or Western blot analysis using probes or antibodies, respectively, that are specific to the reporter gene.

In certain embodiments, the repoirter gene emits a fluorescent signal that can be detected in a FACS. FACS can be used to detect cells in which the reporter gene is expressed.

Techniques for practicing the specific aspect of this invention will employ, unless otherwise indicated, conventional techniques of molecular biology, microbiology, and recombinant DNA manipulation and production, which are routinely practiced by one of skill in the art. See, e.g., Sambrook et al., Molecular cloning, a laboratory manual, second ed., vol. 1-3. (Cold Spring Harbor Laboratory, 1989), A Laboratory Manual, Second Edition; DNA Cloning, Volumes I and II (Glover, Ed. 1985); and Transcription and Translation (Hames & Higgins, Eds. 1984).

The biochemical activity of the reporter gene product represents the expression level of the reporter gene. The total level of reporter gene activity depends also on the replication rate of the recombinant virus of the invention. Thus, to determine the true expression level of the reporter gene from the recombinant virus, the total expression level should be divided by the titer of the recombinant virus in the cell culture or the animal model.

Reporter genes that can be used with the methods of invention include, but are not limited to, the genes listed in the Table 4 below:

TABLE 4

Reporter genes and the biochemical properties of the respective reporter gene products

| Reporter Gene | Protein Activity & Measurement |
|---|---|
| CAT (chloramphenicol acetyltransferase) | Transfers radioactive acetyl groups to chloramphenicol or detection by thin layer chromatography and autoradiography |
| GAL (β-galactosidase) | Hydrolyzes colorless galactosides to yield colored products. |
| GUS (β-glucuronidase) | Hydrolyzes colorless glucuronides to yield colored products. |
| LUC (luciferase) | Oxidizes luciferin, emitting photons |
| GFP (green fluorescent protein) | fluorescent protein without substrate |
| SEAP (secreted alkaline phosphatase) | luminescence reaction with suitable substrates or with substrates that generate chromophores |
| HRP (horseradish peroxidase) | in the presence of hydrogen oxide, oxidation of 3,3',5,5'-tetramethylbenzidine to form a colored complex |
| AP (alkaline phosphatase) | luminescence reaction with suitable substrates or with substrates that generate chromophores |

The abundance of the reporter gene can be measured by, inter alia, Western blot analysis or Northern blot analysis or any other technique used for the quantification of transcription of a nucleotide sequence, the abundance of its mRNA its protein (seeShort Protocols in Molecular Biology, Ausubel et al., (editors), John Wiley & Sons, Inc., $4_{th}$ edition, 1999). In certain embodiments, the activity of the reporter gene product is measured as a readout of reporter gene expression from the recombinant virus. For the quantification of the activity of the reporter gene product, biochemical characteristics of the reporter gene product can be employed (see Table 4). The methods for measuring the biochemical activity of the reporter gene products are well-known to the skilled artisan. A more detailed description of illustrative reporter genes that can be used with the methods of the invention is set forth below.

5.8.3 Measurement of Incidence of Infection Rate

The incidence of infection can be determined by any method well-known in the art, for example, but not limited to, clinical samples (e.g., nasal swabs) can be tested for the presence of a virus of the invention by immunofluorescence assay (IFA) using an anti-APV-antigen antibody, an anti-hMPV-antigen antibody, an anti-APV-antigen antibody, and/or an antibody that is specific to the gene product of the heterologous nucleotide sequence, respectively.

In certain embodiments, samples containing intact cells can be directly processed, whereas isolates without intact cells should first be cultured on a permissive cell line (e.g. HEp-2 cells). In an illustrative embodiments, cultured cell suspensions should be cleared by centrifugation at, e.g., 300×g for 5 minutes at room temperature, followed by a PBS, pH 7.4 (Ca++ and Mg++ free) wash under the same conditions. Cell pellets are resuspended in a small volume of PBS for analysis. Primary clinical isolates containing intact cells are mixed with PBS and centrifuged at 300×g for 5 minutes at room temperature. Mucus is removed from the interface with a sterile pipette tip and cell pellets are washed once more with PBS under the same conditions. Pellets are then resuspended in a small volume of PBS for analysis. Five to ten microliters of each cell suspension are spotted per 5 mm well on acetone washed 12-well HTC supercured glass slides and allowed to air dry. Slides are fixed in cold (−20° C.) acetone for 10 minutes. Reactions are blocked by adding PBS-1% BSA to each well followed by a 10 minute incubation at room temperature. Slides are washed three times in PBS-0.1% Tween-20 and air dried. Ten microliters of each primary antibody reagent diluted to 250 ng/ml in blocking buffer is spotted per well and reactions are incubated in a humidified 37° C. environment for 30 minutes. Slides are then washed extensively in three changes of PBS-0.1% Tween-20 and air dried. Ten microliters of appropriate secondary conjugated antibody reagent diluted to 250 ng/ml in blocking buffer are spotted per respective well and reactions are incubated in a humidified 37° C. environment for an additional 30 minutes. Slides are then washed in three changes of PBS-0.1% Tween-20. Five microliters of PBS-50% glycerol-10 mM Tris pH 8.0-1 mM EDTA are spotted per reaction well, and slides are mounted with cover slips. Each reaction well is subsequently analyzed by fluorescence microscopy at 200× power using a B-2A filter (EX 450-490 nm). Positive reactions are scored against an autofluorescent background obtained from unstained cells or cells stained with secondary reagent alone. Positive reactions are characterized by bright fluorescence punctuated with small inclusions in the cytoplasm of infected cells.

5.8.4 Measurement of Serum Titer

Antibody serum titer can be determined by any method well-known in the art, for example, but not limited to, the amount of antibody or antibody fragment in serum samples can be quantitated by a sandwich ELISA. Briefly, the ELISA consists of coating microtiter plates overnight at 4° C. with an antibody that recognizes the antibody or antibody fragment in the serum. The plates are then blocked for approximately 30 minutes at room temperature with PBS-Tween-0.5% BSA. Standard curves are constructed using purified antibody or antibody fragment diluted in PBS-TWEEN-BSA, and samples are diluted in PBS-BSA. The samples and standards are added to duplicate wells of the assay plate and are incubated for approximately 1 hour at room temperature. Next, the non-bound antibody is washed away with PBS-TWEEN and the bound antibody is treated with a labeled secondary antibody (e.g., horseradish peroxidase conjugated goat-anti-human IgG) for approximately 1 hour at room temperature. Binding of the labeled antibody is detected by adding a chromogenic substrate specific for the label and measuring the rate of substrate turnover, e.g., by a spectrophotometer. The concentration of antibody or antibody fragment levels in the serum is determined by comparison of the rate of substrate turnover for the samples to the rate of substrate turnover for the standard curve at a certain dilution.

5.8.5 Serological Tests

In certain embodiments of the invention, the presence of antibodies that bind to a component of a mammalian MPV is detected. In particular the presence of antibodies directed to a protein of a mammalian MPV can be detected in a subject to diagnose the presence of a mammalian MPV in the subject. Any method known to the skilled artisan can be used to detect the presence of antibodies directed to a component of a mammalian MPV.

In an illustrative embodiment, components of mammalian MPV are linked to a solid support. In a specific embodiment, the component of the mammalian MPV can be, but is not limited to, the F protein or the G protein. Subsequently, the material that is to be tested for the presence of antibodies directed to mammalian MPV is incubated with the solid support under conditions conducive to the binding of the antibodies to the mammalian MPV components. Subsequently, the solid support is washed under conditions that remove any unspecifically bound antibodies. Following the washing step, the presence of bound antibodies can be detected using any technique known to the skilled artisan. In a specific embodiment, the mammalian MPV protein-antibody complex is incubated with detectably labeled antibody that recognizes antibodies that were generated by the species of the subject, e.g., if the subject is a cotton rat, the detectably labeled antibody is directed to rat antibodies, under conditions conducive to the binding of the detectably labeled antibody to the antibody that is bound to the component of mammalian MPV. In a specific embodiment, the detectably labeled antibody is conjugated to an enzymatic activity. In another embodiment, the detectably labeled antibody is radioactively labeled. The complex of mammalian MPV protein-antibody-detectably labeled antibody is then washed, and subsequently the presence of the detectably labeled antibody is quantified by any technique known to the skilled artisan, wherein the technique used is dependent on the type of label of the detectably labeled antibody.

5.8.6 Biacore Assay

Determination of the kinetic parameters of antibody binding can be determined for example by the injection of 250 µL of monoclonal antibody ("mAb") at varying concentration in HBS buffer containing 0.05% Tween-20 over a sensor chip surface, onto which has been immobilized the antigen. The antigen can be any component of a mammalian MPV. In a specific embodiment, the antigen can be, but is not limited to, the F protein or the G protein of a mammalian MPV. The flow rate is maintained constant at 75 uL/min. Dissociation data is collected for 15 min, or longer as necessary. Following each injection/dissociation cycle, the bound mAb is removed from the antigen surface using brief, 1 min pulses of dilute acid, typically 10-100 mM HCl, though other regenerants are employed as the circumstances warrant.

More specifically, for measurement of the rates of association, $k_{on}$, and dissociation, $k_{off}$, the antigen is directly immobilized onto the sensor chip surface through the use of standard amine coupling chemistries, namely the EDC/NHS method (EDC=N-diethylaminopropyl)-carbodiimide). Briefly, a 5-100 nM solution of the antigen in 10 mM NaOAc, pH 4 or pH 5 is prepared and passed over the EDC/NHS-activated surface until approximately 30-50 RU's (Biacore Resonance Unit) worth of antigen are immobilized. Following this, the unreacted active esters are "capped" off with an injection of 1M Et-NH2. A blank surface, containing no antigen, is prepared under identical immobilization conditions for reference purposes. Once a suitable surface has been prepared, an appropriate dilution series of each one of the antibody reagents is prepared in HBS/Tween-20, and passed over both the antigen and reference cell surfaces, which are connected in series. The range of antibody concentrations that are prepared varies depending on what the equilibrium binding constant, $K_D$, is estimated to be. As described above, the bound antibody is removed after each injection/dissociation cycle using an appropriate regenerant.

Once an entire data set is collected, the resulting binding curves are globally fitted using algorithms supplied by the instrument manufacturer, BIAcore, Inc. (Piscataway, N.J.). All data are fitted to a 1:1 Langmuir binding model. These algorithm calculate both the $k_{on}$ and the $k_{off}$, from which the apparent equilibrium binding constant, $K_D$, is deduced as the ratio of the two rate constants (i.e. $k_{off}/k_{on}$). More detailed treatments of how the individual rate constants are derived can be found in the BIAevaluation Software Handbook (BIAcore, Inc., Piscataway, N.J.).

5.8.7 Microneutralization Assay

The ability of antibodies or antigen-binding fragments thereof to neutralize virus infectivity is determined by a microneutralization assay. This microneutralization assay is a modification of the procedures described by Anderson et al., (1985, J. Clin. Microbiol. 22:1050-1052, the disclosure of which is hereby incorporated by reference in its entirety). The procedure is also described in Johnson et al., 1999, J. Infectious Diseases 180:35-40, the disclosure of which is hereby incorporated by reference in its entirety.

Antibody dilutions are made in triplicate using a 96-well plate. $10^6$ $TCID_{50}$ of a mammalian MPV are incubated with serial dilutions of the antibody or antigen-binding fragments thereof to be tested for 2 hours at 37° C. in the wells of a 96-well plate. Cells susceptible to infection with a mammalian MPV, such as, but not limited to Vero cells ($2.5 \times 10^4$) are then added to each well and cultured for 5 days at 37° C. in 5% $CO_2$. After 5 days, the medium is aspirated and cells are washed and fixed to the plates with 80% methanol and 20% PBS. Virus replication is then determined by viral antigen, such as F protein expression. Fixed cells are incubated with a biotin-conjugated anti-viral antigen, such as anti-F protein monoclonal antibody (e.g., pan F protein, C-site-specific MAb 133-1H) washed and horseradish peroxidase conjugated avidin is added to the wells. The wells are washed again and turnover of substrate TMB (thionitrobenzoic acid) is measured at 450 nm. The neutralizing titer is expressed as the antibody concentration that causes at least 50% reduction in absorbency at 450 nm (the $OD_{450}$) from virus-only control cells.

The microneutralization assay described here is only one example. Alternatively, standard neutralization assays can be used to determine how significantly the virus is affected by an antibody.

5.8.8 Viral Fusion Inhibition Assay

This assay is in principle identical to the microneutralization assay, except that the cells are infected with the respective virus for four hours prior to addition of antibody and the read-out is in terms of presence of absence of fusion of cells (Taylor et al., 1992, J. Gen. Virol. 73:2217-2223).

5.8.9 Isothermal Titration Calorimetry

Thermodynamic binding affinities and enthalpies are determined from isothermal titration calorimetry (ITC) measurements on the interaction of antibodies with their respective antigen.

Antibodies are diluted in dialysate and the concentrations were determined by UV spectroscopic absorption measurements with a Perkin-Elmer Lambda 4B Spectrophotometer using an extinction coefficient of 217,000 $M^{-1}$ $cm^{-1}$ at the peak maximum at 280 nm. The diluted mammalian MPV-antigen concentrations are calculated from the ratio of the mass of the original sample to that of the diluted sample since its extinction coefficient is too low to determine an accurate concentration without employing and losing a large amount of sample.

ITC Measurements

The binding thermodynamics of the antibodies are determined from ITC measurements using a Microcal, Inc. VP Titration Calorimeter. The VP titration calorimeter consists of a matched pair of sample and reference vessels (1.409 ml) enclosed in an adiabatic enclosure and a rotating stirrer-syringe for titrating ligand solutions into the sample vessel. The ITC measurements are performed at 25° C. and 35° C. The sample vessel contained the antibody in the phosphate buffer while the reference vessel contains just the buffer solution. The phosphate buffer solution is saline 67 mM $PO_4$ at pH 7.4 from HyClone, Inc. Five or ten μl aliquots of the 0.05 to 0.1 mM RSV-antigen, PIV-antigen, and/or hMPV-antigen solution are titrated 3 to 4 minutes apart into the antibody sample solution until the binding is saturated as evident by the lack of a heat exchange signal.

A non-linear, least square minimization software program from Microcal, Inc., Origin 5.0, is used to fit the incremental heat of the i-th titration ($\Delta Q$ (i)) of the total heat, $Q_t$, to the total titrant concentration, $X_t$, according to the following equations (I), $$Q_t = nC_t\Delta H_b°V\{1+X_t/nC_t+1/nK_bC_t-[(1+X_t/nC_t+1/nK_bC_t)^2-4X_t/nC_t]^{1/2}\}/2 \quad (1a)$$

$$\Delta Q(i) = Q(i) + dVi/2V\{Q(i)+Q(i-1)\}-Q(i-1) \quad (1b)$$

where $C_t$ is the initial antibody concentration in the sample vessel, V is the volume of the sample vessel, and n is the stoichiometry of the binding reaction, to yield values of $K_b$, $\Delta H_b°$, and n. The optimum range of sample concentrations for the determination of $K_b$ depends on the value of $K_b$ and is defined by the following relationship.

$$C_tK_bn \leq 500 \quad (2)$$

so that at 1 μM the maximum $K^b$ that can be determined is less than $2.5 \times 10^8$ $M^{-1}$. If the first titrant addition does not fit the binding isotherm, it was neglected in the final analysis since it may reflect release of an air bubble at the syringe opening-solution interface.

5.8.10 Immunoassays

Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, 159 aprotinin, sodium vanadate), adding the antibody of interest to the cell lysate, incubating for a period of time (e.g., to 4 hours) at 4 degrees C., adding protein A and/or protein G sepharose beads to the cell lysate, incubating for about an hour or more at 4 degrees C., washing the beads in lysis buffer and re-suspending the beads in SDS/sample buffer. The ability of the antibody of interest to immunoprecipitate a particular antigen can be assessed by, e.g., western blot analysis. One of skill in the art would be knowledgeable as to the parameters that can be modified to increase the binding of the antibody to an antigen and decrease the background (e.g., pre-clearing the cell lysate with sepharose beads). For further discussion regarding immunoprecipitation protocols see, e.g., Ausubel et al., eds., 1994, Current Protocols in Molecular Biology, Vol. 1, John Wiley & Sons, Inc., New York at pages 10, 16, 1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide get to a membrane such as nitrocellulose, PVDF or nylon, blocking the membrane, in blocking solution (e.g., PBS with 3% BSA or non-fat milk), washing the membrane in washing buffer (e.g., PBSTween20), incubating the membrane with primary antibody (the antibody of interest) diluted in blocking buffer, washing the membrane in washing buffer, incubating the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{12}P$ or $^{121}I$) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al., eds, 1994, GinTent Protocols in Molecular Biology, Vol. 1, John Wiley & Sons, Inc., New York at 10.8.1.

ELISAs comprise preparing antigen, coating the well of a 96-well microtiter plate with the antigen, washing away antigen that did not bind the wells, adding the antibody of interest conjugated to a detectable compound such as an enzymatic substrate (e.g., horseradish peroxidase or alkaline phosphatase) to the wells and incubating for a period of time, washing away unbound antibodies or non-specifically bound antibodies, and detecting the presence of the antibodies specifically bound to the antigen coating the well. In ELISAs the antibody of interest does not have to be conjugated to a detectable compound; instead, a second antibody (which recognizes the antibody of interest) conjugated to a detectable compound may be added to the well. Further, instead of coating the well with the antigen, the antibody may be coated to the well. In this case, the detectable molecule could be the antigen conjugated to a detectable compound such as an enzymatic substrate (e.g., horseradish peroxidase or alkaline phosphatase). The parameters that can be modified to increase signal detection and other variations of ELISAs are well known to one of skill in the art. For further discussion regarding ELISAs see, e.g., Ausubel et al., eds, 1994, Current Protocols in Molecular Biology, Vol. I, John Wiley & Sons, Inc., New York at 11.2.1.

The binding affinity of an antibody (including a scFv or other molecule comprising, or alternatively consisting of, antibody fragments or variants thereof) to an antigen and the off-rate of an antibody-antigen interaction can be determined by competitive binding assays. One example of a competitive binding assay is a radioimmunoassay comprising the incubation of labeled antigen (e.g., $^3H$ or $^{121}I$) with the antibody of interest in the presence of increasing amounts of unlabeled antigen, and the detection of the antibody bound to the labeled antigen.

5.8.11 Sucrose Gradient Assay

The question of whether the heterologous proteins are incorporated into the virion can be further investigated by use of any biochemical assay known to the skilled artisan. In a specific embodiment, a sucrose gradient assay is used to determine whether a heterologous protein is incorporated into the virion.

Infected cell lysates can be fractionated in 20-60% sucrose gradients, various fractions are collected and analyzed for the presence and distribution of heterologous proteins and the vector proteins by, e.g., Western blot analysis. The fractions and the virus proteins can also be assayed for peak virus titers by plaque assay. If the heterologous protein co-migrates with the virion the heterologous protein is associated with the virion.

5.9 Methods to Identify New Isolates of MPV

The present invention relates to mammalian MPV, in particular hMPV. While the present invention provides the characterization of two serological subgroups of MPV, A and B, and the characterization of four variants of MPV A1, A2, B1 and B2, the invention is not limited to these subgroups and variants. The invention encompasses any yet to be identified isolates of MPV, including those which are characterized as belonging to the subgroups and variants described herein, or belonging to a yet to be characterized subgroup or variant.

Immunoassays can be used in order to characterize the protein components that are present in a given sample. Immunoassays are an effective way to compare viral isolates using peptides components of the viruses for identification. For example, the invention provides herein a method to identify further isolates of MPV as provided herein, the method comprising inoculating an essentially MPV-uninfected or specific-pathogen-free guinea pig or ferret (in the detailed description the animal is inoculated intranasally but other was of inoculation such as intramuscular or intradermal inoculation, and using an other experimental animal, is also feasible) with the prototype isolate I-2614 or related isolates. Sera are collected from the animal at day zero, two weeks and three weeks post inoculation. The animal specifically seroconverted as measured in virus neutralization (VN) assay (For an example of a VN assay, see Example 16) and indirect IFA (For an example of IFA, see Example 11 or 14) against the respective isolate I-2614 and the sera from the seroconverted animal are used in the immunological detection of said further isolates. As an example, the invention provides the characterization of a new member in the family of Paramyxoviridae, a human *metapneumovirus* or *metapneumovirus*-like virus (since its final taxonomy awaits discussion by a viral taxonomy committee the MPV is herein for example described as taxonomically corresponding to APV) (MPV) which may cause severe RTI in humans. The clinical signs of the disease caused by MPV are essentially similar to those caused by hRSV, such as cough, myalgia, vomiting, fever broncheolitis or pneumonia, possible conjunctivitis, or combinations thereof. As is seen with hRSV infected children, specifically very young children may require hospitalization. As an example an MPV which was deposited Jan. 19, 2001 as I-2614 with CNCM, Institute Pasteur, Paris or a virus isolate phylogenetically corresponding therewith is herewith provided. Therewith, the invention provides a virus comprising a nucleic acid or functional fragment phylogenetically corresponding to a nucleic acid sequence of SEQ. ID NO:19, or structurally corresponding therewith. In particular the invention provides a virus characterized in that after testing it in phylogenetic tree analysis wherein maximum likelihood trees are generated using 100 bootstraps and 3 jumbles it is found to be more closely phylogenetically corresponding to a virus isolate deposited as I-2614 with CNCM, Paris than it is related to a virus isolate of avian pnuemovirus (APV) also known as turkey rhinotracheitis virus (TRTV), the aetiological agent of avian rhinotracheitis. It is particularly useful to use an AVP-C virus isolate as outgroup in said phylogenetic tree analysis, it being the closest relative, albeit being an essentially non-mammalian virus.

5.9.1 Bioinformatics Alignment of Sequences

Two or more amino acid sequences can be compared by BLAST (Altschul, S. F. et al., 1990, J. Mol. Biol. 215:403-410) to determine their sequence homology and sequence identities to each other. Two or more nucleotide sequences can be compared by BLAST (Altschul, S. F. et al., 1990, J. Mol. Biol. 215:403-410) to determine their sequence homology and sequence identities to each other. BLAST comparisons can be performed using the Clustal W method (MacVector(tm)). In certain specific embodiments, the alignment of two or more sequences by a computer program can be followed by manual re-adjustment.

The determination of percent identity between two sequences can be accomplished using a mathematical algorithm. A preferred, non-limiting example of a mathematical algorithm utilized for the comparison of two sequences is the algorithm of Karlin and Altschul, 1990, Proc. Natl. Acad. Sci. USA 87:2264-2268, modified as in Karlin and Altschul, 1993, Proc. Natl. Acad. Sci. USA 90:5873-5877. Such an algorithm is incorporated into the NBLAST and XBLAST programs of Altschul et al., 1990, J. Mol. Biol. 215:403-410. BLAST nucleotide comparisons can be performed with the NBLAST program. BLAST amino acid sequence comparisons can be performed with the XBLAST program. To obtain gapped alignments for comparison purposes, Gapped BLAST can be utilized as described in Altschul et al., 1997, Nucleic Acids Res.25:3389-3402. Alternatively, PSI-Blast can be used to perform an iterated search which detects distant relationships between molecules (Altschul et al., 1997, supra). When utilizing BLAST, Gapped BLAST, and PSI-Blast programs, the default parameters of the respective programs (e.g., XBLAST and NBLAST) can be used (seehttp://www.ncbi.nlm.nih.gov). Another preferred, non-limiting example of a mathematical algorithm utilized for the comparison of sequences is the algorithm of Myers and Miller, 1988, CABIOS 4:11-17. Such an algorithm is incorporated into the ALIGN program (version 2.0) which is part of the GCG sequence alignment software package. When utilizing the ALIGN program for comparing amino acid sequences, a PAM120 weight residue table can be used. The gap length penalty can be set by the skilled artisan. The percent identity between two sequences can be determined using techniques similar to those described above, with or without allowing gaps. In calculating percent identity, typically only exact matches are counted.

5.9.2 Hybridization Conditions

A nucleic acid which is hybridizable to a nucleic acid of a mammalian MPV, or to its reverse complement, or to its complement can be used in the methods of the invention to determine their sequence homology and identities to each other. In certain embodiments, the nucleic acids are hybridized under conditions of high stringency. By way of example and not limitation, procedures using such conditions of high stringency are as follows. Prehybridization of filters containing DNA is carried out for 8 h to overnight at 65 C in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65 C in prehybridization mixture containing 100 µg/ml denatured salmon sperm DNA and 5-20×106 cpm of 32P-labeled probe. Washing of filters is done at 37 C for 1 h in a solution containing 2×SSC, 0.01% PVP, 0.01% Ficoll, and 0.01% BSA. This is followed by a wash in 0.1×SSC at 50 C for 45 min before autoradiography. Other conditions of high stringency which may be used are well known in the art. In other embodiments of the invention, hybridization is performed under moderate of low stringency conditions, such conditions are well-known to the skilled artisan (see e.g., Sambrook et al., 1989, Molecular Cloning, A Laboratory Manual, 2d Ed., Cold Spring Harbor Laboratory Press, Cold Spring Harbor, N.Y.; see also, Ausubel et al., eds., in the Current Protocols in Molecular Biology series of laboratory technique manuals, 1987-1997 Current Protocols,© 1994-1997 John Wiley and Sons, Inc.).

5.9.3 Phylogenetic Analysis

This invention relates to the inference of phylogenetic relationships between isolates of mammalian MPV. Many methods or approaches are available to analyze phylogenetic relationship; these include distance, maximum likelihood, and maximum parsimony methods (Swofford, D L., et. al., Phylogenetic Inference. In Molecular Systematics. Eds. Hillis, DM, Mortiz, C, and Mable, B K. 1996. Sinauer Associates: Massachusetts, USA. pp. 407-514; Felsenstein, J., 1981, J. Mol. Evol. 17:368-376). In addition, bootstrapping techniques are an effective means of preparing and examining confidence intervals of resultant phylogenetic trees (Felsenstein, J., 1985, Evolution. 29:783-791). Any method or approach using nucleotide or peptide sequence information to compare mammalian MPV isolates can be used to establish phylogenetic relationships, including, but not limited to, distance, maximum likelihood, and maximum parsimony methods or approaches. Any method known in the art can be used to analyze the quality of phylogenetic data, including but not limited to bootstrapping. Alignment of nucleotide or peptide sequence data for use in phylogenetic approaches, include but are not limited to, manual alignment, computer pairwise alignment, and computer multiple alignment. One skilled in the art would be familiar with the preferable alignment method or phylogenetic approach to be used based upon the information required and the time allowed.

In one embodiment, a DNA maximum likehood method is used to infer relationships between hMPV isolates. In another embodiment, bootstrapping techniques are used to determine the certainty of phylogenetic data created using one of said phylogenetic approaches. In another embodiment, jumbling techniques are applied to the phylogenetic approach before the input of data in order to minimize the effect of sequence order entry on the phylogenetic analyses. In one specific embodiment, a DNA maximum likelihood method is used with bootstrapping. In another specific embodiment, a DNA maximum likelihood method is used with bootstrapping and jumbling. In another more specific embodiment, a DNA maximum likelihood method is used with 50 bootstraps. In another specific embodiment, a DNA maximum likelihood method is used with 50 bootstraps and 3 jumbles. In another specific embodiment, a DNA maximum likelihood method is used with 100 bootstraps and 3 jumbles.

In one embodiment, nucleic acid or peptide sequence information from an isolate of hMPV is compared or aligned with sequences of other hMPV isolates. The amino acid sequence can be the amino acid sequence of the L protein, the M protein, the N protein, the P protein, or the F protein. In another embodiment, nucleic acid or peptide sequence information from an hMPV isolate or a number of hMPV isolates is compared or aligned with sequences of other viruses. In another embodiment, phylogenetic approaches are applied to sequence alignment data so that phylogenetic relationships can be inferred and/or phylogenetic trees constructed. Any method or approach that uses nucleotide or peptide sequence information to compare hMPV isolates can be used to infer said phylogenetic relationships, including, but not limited to, distance, maximum likelihood, and maximum parsimony methods or approaches.

Other methods for the phylogenetic analysis are disclosed in International Patent Application PCT/NL02/00040, published as WO 02/057302, which is incorporated in its entirety herein. In particular, PCT/NL02/00040 discloses nucleic acid sequences that are suitable for phylogenetic analysis at page 12, line 27 to page 19, line29, which is incorporated herein by reference.

For the phylogenetic analyses it is most useful to obtain the nucleic acid sequence of a non-MPV as outgroup with which the virus is to be compared, a very useful outgroup isolate can be obtained from avian pneumovirus serotype C (APV-C), see, e.g., FIG. 16.

Many methods and programs are known in the art and can be used in the inference of phylogenetic relationships, including, but not limited to BioEdit, ClustalW, TreeView, and NJPlot. Methods that would be used to align sequences and to generate phylogenetic trees or relationships would require the input of sequence information to be compared. Many methods or formats are known in the art and can be used to input sequence information, including, but not limited to, FASTA, NBRF, EMBL/SWISS, GDE protein, GDE nucleotide, CLUSTAL, and GCG/MSF. Methods that would be used to align sequences and to generate phylogenetic trees or relationships would require the output of results. Many methods or formats can be used in the output of information or results, including, but not limited to, CLUSTAL, NBRF/PIR, MSF, PHYLIP, and GDE. In one embodiment, ClustalW is used in conjunction with DNA maximum likelihood methods with 100 bootstraps and 3 jumbles in order to generate phylogenetic relationships.

5.10 Generation of Antibodies

The invention also relates to the generation of antibodies against a protein encoded by a mammalian MPV. In particular, the invention relates to the generation of antibodies against all MPV antigens, including the F protein, N protein, M2-1 protein, M2-2 protein, G protein, or P protein of a mammalian MPV. According to the invention, any protein encoded by a mammalian MPV, derivatives, analogs or fragments thereof, may be used as an immunogen to generate antibodies which immunospecifically bind such an immunogen. Antibodies of the invention include, but are not limited to, polyclonal, monoclonal, multispecific, human, humanized or chimeric antibodies, single chain antibodies, Fab fragments, F(ab') fragments, fragments produced by a Fab expression library, anti-idiotypic (anti-Id) antibodies (including, e.g., anti-Id antibodies to antibodies of the invention), and epitope-binding fragments. The term "antibody," as used herein, refers to immunoglobulin molecules and immunologically active portions of immunoglobulin molecules, i.e., molecules that contain an antigen binding site that immunospecifically binds an antigen. The immunoglobulin molecules of the invention can be of any type (e.g., IgG, IgE, IgM, IgD, IgA and IgY), class (e.g., $IgG_1$, $IgG_2$, $IgG_3$, $IgG_4$, $IgA_1$, and $IgA_2$) or subclass of immunoglobulin molecule. Examples of immunologically active portions of immunoglobulin molecules include F(ab) and $F(ab')_2$ fragments which can be generated by treating the antibody with an enzyme such as pepsin or papain. In a specific embodiment, antibodies to a protein encoded by human MPV are produced. In another embodiment, antibodies to a domain a protein encoded by human MPV are produced.

Various procedures known in the art may be used for the production of polyclonal antibodies against a protein encoded by a mammalian MPV, derivatives, analogs or fragments thereof. For the production of antibody, various host animals can be immunized by injection with the native protein, or a synthetic version, or derivative (e.g., fragment) thereof, including but not limited to rabbits, mice, rats, etc. Various adjuvants may be used to increase the immunological response, depending on the host species, and including but not limited to Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (bacille Calmette-Guerin) and corynebacterium parvum.

For preparation of monoclonal antibodies directed toward a protein encoded by a mammalian MPV, derivatives, analogs or fragments thereof, any technique which provides for the production of antibody molecules by continuous cell lines in culture may be used. For example, the hybridoma technique originally developed by Kohler and Milstein (1975, Nature 256:495-497), as well as the trioma technique, the human B-cell hybridoma technique (Kozbor et al., 1983, Immunology Today 4:72), and the EBV-hybridoma technique to produce human monoclonal antibodies (Cole et al., 1985, in Monoclonal Antibodies and Cancer Therapy, Alan R. Liss, Inc., pp. 77-96). In an additional embodiment of the invention, monoclonal antibodies can be produced in germ-free animals utilizing recent technology (PCT/US90/02545). According to the invention, human antibodies may be used and can be obtained by using human hybridomas (Cote et al., 1983, Proc. Natl. Acad. Sci. U.S.A. 80:2026-2030) or by transforming human B cells with EBV virus in vitro (Cole et al., 1985, in Monoclonal Antibodies and Cancer Therapy, Alan R. Liss, pp. 77-96). In fact, according to the invention, techniques developed for the production of "chimeric antibodies" (Morrison et al., 1984, Proc. Natl. Acad. Sci. U.S.A. 81:6851-6855; Neuberger et al., 1984, Nature 312:604-608; Takeda et al., 1985, Nature 314:452-454) by splicing the genes from a mouse antibody molecule specific for a protein encoded by a mammalian MPV, derivatives, analogs or fragments thereof together with genes from a human antibody molecule of appropriate biological activity can be used; such antibodies are within the scope of this invention.

According to the invention, techniques described for the production of single chain antibodies (U.S. Pat. No. 4,946,778) can be adapted to produce specific single chain antibodies. An additional embodiment of the invention utilizes the techniques described for the construction of Fab expression libraries (Huse et al., 1989, Science 246:1275-1281) to allow rapid and easy identification of monoclonal Fab fragments with the desired specificity for a protein encoded by a mammalian MPV, derivatives, analogs or fragments thereof.

Antibody fragments which contain the idiotype of the molecule can be generated by known techniques. For example, such fragments include but are not limited to: the F(ab')2 fragment which can be produced by pepsin digestion of the antibody molecule; the Fab' fragments which can be generated by reducing the disulfide bridges of the F(ab')2 fragment, the Fab fragments which can be generated by treating the antibody molecule with papain and a reducing agent, and Fv fragments.

In the production of antibodies, screening for the desired antibody can be accomplished by techniques known in the art, e.g. ELISA (enzyme-linked immunosorbent assay). For example, to select antibodies which recognize a specific domain of a protein encoded by a mammalian MPV, one may assay generated hybridomas for a product which binds to a fragment of a protein encoded by a mammalian MPV containing such domain.

The antibodies provided by the present invention can be used for detecting MPV and for therapeutic methods for the treatment of infections with MPV.

The specificity and binding affinities of the antibodies generated by the methods of the invention can be tested by any technique known to the skilled artisan. In certain embodiments, the specificity and binding affinities of the antibodies generated by the methods of the invention can be tested as described in sections 5.8.5, 5.8.6, 5.8.7, 5.8.8 or 5.8.9.

5.11 Screening Assays to Identify Antiviral Agents

The invention provides methods for the identification of a compound that inhibits the ability of a mammalian MPV to infect a host or a host cell. In certain embodiments, the invention provides methods for the identification of a compound that reduces the ability of a mammalian MPV to replicate in a host or a host cell. Any technique well-known to the skilled artisan can be used to screen for a compound that would abolish or reduce the ability of a mammalian MPV to infect a host and/or to replicate in a host or a host cell. In a specific embodiment, the mammalian MPV is a human MPV.

In certain embodiments, the invention provides methods for the identification of a compound that inhibits the ability of a mammalian MPV to replicate in a mammal or a mammalian cell. More specifically, the invention provides methods for the identification of a compound that inhibits the ability of a mammalian MPV to infect a mammal or a mammalian cell. In certain embodiments, the invention provides methods for the identification of a compound that inhibits the ability of a mammalian MPV to replicate in a mammalian cell. In a specific embodiment, the mammalian cell is a human cell. For a detailed description of assays that can be used to determine virus titer see section 5.7.

In certain embodiments, a cell is contacted with a test compound and infected with a mammalian MPV. In certain embodiments, a control culture is infected with a mammalian virus in the absence of a test compound. The cell can be contacted with a test compound before, concurrently with, or subsequent to the infection with the mammalian MPV. In a specific embodiment, the cell is a mammalian cell. In an even more specific embodiment, the cell is a human cell. In certain embodiments, the cell is incubated with the test compound for at least 1 minute, at least 5 minutes at least 15 minutes, at least 30 minutes, at least 1 hour, at least 2 hours, at least 5 hours, at least 12 hours, or at least 1 day. The titer of the virus can be measured at any time during the assay. In certain embodiments, a time course of viral growth in the culture is determined. If the viral growth is inhibited or reduced in the presence of the test compound, the test compound is identified as being effective in inhibiting or reducing the growth or infection of a mammalian MPV. In a specific embodiment, the compound that inhibits or reduces the growth of a mammalian MPV is tested for its ability to inhibit or reduce the growth rate of other viruses to test its specificity for mammalian MPV.

In certain embodiments, a test compound is administered to a model animal and the model animal is infected with a mammalian MPV. In certain embodiments, a control model animal is infected with a mammalian virus in without the administration of a test compound. The test compound can be administered before, concurrently with, or subsequent to the infection with the mammalian MPV. In a specific embodiment, the model animal is a mammal. In an even more specific embodiment, the model animal can be, but is not limited to, a cotton rat, a mouse, or a monkey. The titer of the virus in the model animal can be measured at any time during the assay. In certain embodiments, a time course of viral growth in the culture is determined. If the viral growth is inhibited or reduced in the presence of the test compound, the test compound is identified as being effective in inhibiting or reducing the growth or infection of a mammalian MPV. In a specific embodiment, the compound that inhibits or reduces the growth of a mammalian MPV in the model animal is tested for its ability to inhibit or reduce the growth rate of other viruses to test its specificity for mammalian MPV.

5.12 Formulations of Vaccines, Antibodies and Antivirals

In a preferred embodiment, the invention provides a proteinaceous molecule or metapneumovirus-specific viral protein or functional fragment thereof encoded by a nucleic acid according to the invention. Useful proteinaceous molecules are for example derived from any of the genes or genomic fragments derivable from a virus according to the invention. Such molecules, or antigenic fragments thereof, as provided herein, are for example useful in diagnostic methods or kits and in pharmaceutical compositions such as sub-unit vaccines. Particularly useful are the F, SH and/or G protein or antigenic fragments thereof for inclusion as antigen or sub-unit immunogen, but inactivated whole virus can also be used. Particularly useful are also those proteinaceous substances that are encoded by recombinant nucleic acid fragments that are identified for phylogenetic analyses, of course preferred are those that are within the preferred bounds and metes of ORFs useful in phylogenetic analyses, in particular for eliciting MPV specific antibody or T cell responses, whether in vivo (e.g. for protective purposes or for providing diagnostic antibodies) or in vitro (e.g. by phage display technology or another technique useful for generating synthetic antibodies).

Also provided herein are antibodies, be it natural polyclonal or monoclonal, or synthetic (e.g. (phage) library-derived binding molecules) antibodies that specifically react with an antigen comprising a proteinaceous molecule or MPV-specific functional fragment thereof according to the invention. Such antibodies are useful in a method for identifying a viral isolate as an MPV comprising reacting said viral isolate or a component thereof with an antibody as provided herein. This can for example be achieved by using purified or non-purified MPV or parts thereof (proteins, peptides) using ELISA, RIA, FACS or different formats of antigen detection assays (Current Protocols in Immunology). Alternatively, infected cells or cell cultures may be used to identify viral antigens using classical immunofluorescence or immunohistochemical techniques.

A pharmaceutical composition comprising a virus, a nucleic acid, a proteinaceous molecule or fragment thereof, an antigen and/or an antibody according to the invention can for example be used in a method for the treatment or prevention of a MPV infection and/or a respiratory illness comprising providing an individual with a pharmaceutical composition according to the invention. This is most useful when said individual comprises a human, specifically when said human is below 5 years of age, since such infants and young children are most likely to be infected by a human MPV as provided herein. Generally, in the acute phase patients will suffer from upper respiratory symptoms predisposing for other respiratory and other diseases. Also lower respiratory illnesses may occur, predisposing for more and other serious conditions. The compositions of the invention can be used for the treatment of immuno-compromised individuals including cancer patients, transplant recipients and the elderly.

The invention also provides methods to obtain an antiviral agent useful in the treatment of respiratory tract illness comprising establishing a cell culture or experimental animal comprising a virus according to the invention, treating said culture or animal with an candidate antiviral agent, and determining the effect of said agent on said virus or its infection of said culture or animal. An example of such an antiviral agent comprises a MPV-neutralising antibody, or functional component thereof, as provided herein, but antiviral agents of other nature are obtained as well. The invention also provides use of an antiviral agent according to the invention for the preparation of a pharmaceutical composition, in particular for the preparation of a pharmaceutical composition for the treatment of respiratory tract illness, specifically when caused by an MPV infection or related disease, and provides a pharmaceutical composition comprising an antiviral agent according to the invention, useful in a method for the treatment or prevention of an MPV infection or respiratory illness, said method comprising providing an individual with such a pharmaceutical composition.

In certain embodiments of the invention, the vaccine of the invention comprises mammalian *metapneumovirus* as defined herein. In certain, more specific embodiments, the mammalian *metapneumovirus* is a human *metapneumovirus*. In a preferred embodiment, the mammalian *metapneumovirus* to be used in a vaccine formulation has an attenuated phenotype. For methods to achieve an attenuated phenotype, see section 5.6.

The invention provides vaccine formulations for the prevention and treatment of infections with PIV, RSV, APV, and/or hMPV. In certain embodiments, the vaccine of the invention comprises recombinant and chimeric viruses of the invention. In certain embodiments, the virus is attenuated.

In a specific embodiment, the vaccine comprises APV and the vaccine is used for the prevention and treatment for hMPV infections in humans. Without being bound by theory, because of the high degree of homology of the F protein of APV with the F protein of hMPV, infection with APV will result in the production of antibodies in the host that will cross-react with hMPV and protect the host from infection with hMPV and related diseases.

In another specific embodiment, the vaccine comprises hMPV and the vaccine is used for the prevention and treatment for APV infection in birds, such as, but not limited to, in turkeys. Without being bound by theory, because of the high degree of homology of the F protein of APV with the F protein of hMPV, infection with hMPV will result in the production of antibodies in the host that will cross-react with APV and protect the host from infection with APV and related diseases.

In a specific embodiment, the invention encompasses the use of recombinant and chimeric APV/hMPV viruses which have been modified in vaccine formulations to confer protection against APV and/or hMPV. In certain embodiments, APV/hMPV is used in a vaccine to be administered to birds, to protect the birds from infection with APV. Without being bound by theory, the replacement of the APV gene or nucleotide sequence with a hMPV gene or nucleotide sequence results in an attenuated phenotype that allows the use of the chimeric virus as a vaccine. In other embodiments the APV/hMPV chimeric virus is administered to humans. Without being bound by theory the APV viral vector provides the attenuated phenotype in humans and the expression of the hMPV sequence elicits a hMPV specific immune response.

In a specific embodiment, the invention encompasses the use of recombinant and chimeric hMPV/APV viruses which have been modified in vaccine formulations to confer protection against APV and/or hMPV. In certain embodiments, hMPV/APV is used in a vaccine to be administered to humans, to protect the human from infection with hMPV. Without being bound by theory, the replacement of the hMPV gene or nucleotide sequence with a APV gene or nucleotide sequence results in an attenuated phenotype that allows the use of the chimeric virus as a vaccine. In other embodiments the hMPV/APV chimeric virus is administered to birds. Without being bound by theory the hMPV backbone provides the attenuated phenotype in birds and the expression of the APV sequence elicits an APV specific immune response.

In certain preferred embodiments, the vaccine formulation of the invention is used to protect against infections by a *metapneumovirus* and related diseases. More specifically, the vaccine formulation of the invention is used to protect against infections by a human *metapneumovirus* and/or an avian pneumovirus and related diseases. In certain embodiments, the vaccine formulation of the invention is used to protect against infections by (a) a human *metapneumovirus* and a respiratory syncytial virus; and/or (b) an avian pneumovirus and a respiratory syncytial virus.

In certain embodiments, the vaccine formulation of the invention is used to protect against infections by (a) a human *metapneumovirus* and a human parainfluenza virus; and/or (b) an avian pneumovirus and a human parainfluenza virus, and related diseases.

In certain embodiments, the vaccine formulation of the invention is used to protect against infections by (a) a human *metapneumovirus*, a respiratory syncytial virus, and a human parainfluenza virus; and/or (b) an avian pneumovirus, a respiratory syncytial virus, and a human parainfluenza virus, and related diseases.

In certain embodiments, the vaccine formulation of the invention is used to protect against infections by a human *metapnuemovirus*, a respiratory syncytial virus, and a human parainfluenza virus and related diseases. In certain other embodiments, the vaccine formulation of the invention is used to protect against infections by an avian pneumovirus, a respiratory syncytial virus, and a human parainfluenza virus and related diseases.

Due to the high degree of homology among the F proteins of different viral species, for exemplary amino acid sequence comparisons see FIG. 9, the vaccine formulations of the invention can be used for protection from viruses different from the one from which the heterologous nucleotide sequence encoding the F protein was derived. In a specific exemplary embodiment, a vaccine formulation contains a virus comprising a heterologous nucleotide sequence derived from an avian pneumovirus type A, and the vaccine formulation is used to protect from infection by avian pneumovirus type A and avian pneumovirus type B.

The invention encompasses vaccine formulations to be administered to humans and animals which are useful to protect against APV, including APV-C and APV-D, hMPV, PIV, influenza, RSV, Sendai virus, mumps, laryngotracheitis virus, simianvirus 5, human papillomavirus, measles, mumps, as well as other viruses and pathogens and related diseases. The invention further encompasses vaccine formulations to be administered to humans and animals which are useful to protect against human *metapnuemovirus* infections and avian pneumovirus infections and related diseases.

In one embodiment, the invention encompasses vaccine formulations which are useful against domestic animal disease causing agents including rabies virus, feline leukemia virus (FLV) and canine distemper virus. In yet another embodiment, the invention encompasses vaccine formulations which are useful to protect livestock against vesicular stomatitis virus, rabies virus, rinderpest virus, swinepox virus, and further, to protect wild animals against rabies virus.

Attenuated viruses generated by the reverse genetics approach can be used in the vaccine and pharmaceutical formulations described herein. Reverse genetics techniques can also be used to engineer additional mutations to other viral genes important for vaccine production—i.e., the epitopes of useful vaccine strain variants can be engineered into the attenuated virus. Alternatively, completely foreign epitopes, including antigens derived from other viral or non-viral pathogens, can be engineered into the attenuated strain. For example, antigens of non-related viruses such as HIV (gp160, gp120, gp41) parasite antigens (e.g., malaria), bacterial or fungal antigens or tumor antigens can be engineered into the attenuated strain. Alternatively, epitopes which alter the tropism of the virus in vivo can be engineered into the chimeric attenuated viruses of the invention.

Virtually any heterologous gene sequence may be constructed into the chimeric viruses of the invention for use in vaccines. Preferably moieties and peptides that act as biological response modifiers. Preferably, epitopes that induce a protective immune response to any of a variety of pathogens, or antigens that bind neutralizing antibodies may be expressed by or as part of the chimeric viruses. For example, heterologous gene sequences that can be constructed into the chimeric viruses of the invention include, but are not limited to influenza and parainfluenza hemagglutinin neuraminidase and fusion glycoproteins such as the HN and F genes of human PIV3. In yet another embodiment, heterologous gene sequences that can be engineered into the chimeric viruses include those that encode proteins with immuno-modulating activities. Examples of immuno-modulating proteins include, but are not limited to, cytokines, interferon type 1, gamma interferon, colony stimulating factors, interleukin-1, -2, -4, -5, -6, -12, and antagonists of these agents.

In addition, heterologous gene sequences that can be constructed into the chimeric viruses of the invention for use in vaccines include but are not limited to sequences derived from a human immunodeficiency virus (HIV), preferably type 1 or type 2. In a preferred embodiment, an immunogenic HIV-derived peptide which may be the source of an antigen may be constructed into a chimeric PIV that may then be used to elicit a vertebrate immune response. Such HIV-derived peptides may include, but are not limited to sequences derived from the env gene (i.e., sequences encoding all or part of gp160, gp120, and/or gp41), the pol gene (i.e., sequences encoding all or part of reverse transcriptase, endonuclease, protease, and/or integrase), the gag gene (i.e., sequences encoding all or part of p7, p6, p55, p17/18, p24/25), tat, rev, nef, vif, vpu, vpr, and/or vpx.

Other heterologous sequences may be derived from hepatitis B virus surface antigen (HBsAg); hepatitis A or C virus surface antigens, the glycoproteins of Epstein Barr virus; the glycoproteins of human papillomavirus; the glycoproteins of respiratory syncytial virus, parainfluenza virus, Sendai virus, simianvirus 5 or mumps virus; the glycoproteins of influenza virus; the glycoproteins of herpesviruses; VP1 of poliovirus; antigenic determinants of non-viral pathogens such as bacteria and parasites, to name but a few. In another embodiment, all or portions of immunoglobulin genes may be expressed. For example, variable regions of anti-idiotypic immunoglobulins that mimic such epitopes may be constructed into the chimeric viruses of the invention.

Other heterologous sequences may be derived from tumor antigens, and the resulting chimeric viruses be used to generate an immune response against the tumor cells leading to tumor regression in vivo. These vaccines may be used in combination with other therapeutic regimens, including but not limited to chemotherapy, radiation therapy, surgery, bone marrow transplantation, etc. for the treatment of tumors. In accordance with the present invention, recombinant viruses may be engineered to express tumor-associated antigens (TAAs), including but not limited to, human tumor antigens recognized by T cells (Robbins and Kawakami, 1996, Curr. Opin. Immunol. 8:628-636, incorporated herein by reference in its entirety), melanocyte lineage proteins, including gp100, MART-1/MelanA, TRP-1 (gp75), tyrosinase; Tumor-specific widely shared antigens, MAGE-1, MAGE-3, BAGE, GAGE-1, GAGE-1, N-acetylglucosaminyltransferase-V, p15; Tumor-specific mutated antigens, β-catenin, MUM-1, CDK4; Nonmelanoma antigens for breast, ovarian, cervical and pancreatic carcinoma, HER-2/neu, human papillomavirus-E6, -E7, MUC-1.

In even other embodiments, a heterologous nucleotide sequence is derived from a *metapnuemovirus*, such as human *metapnuemovirus* and/or avian pneumovirus. In even other embodiments, the virus of the invention contains two different heterologous nucleotide sequences wherein one is derived from a *metapnuemovirus*, such as human *metapnuemovirus* and/or avian pneumovirus, and the other one is derived from a respiratory syncytial virus. The heterologous nucleotide sequence encodes a F protein or a G protein of the respective virus. In a specific embodiment, a heterologous nucleotide sequences encodes a chimeric F protein, wherein the chimeric F protein contains the ectodomain of a F protein of a *metapnuemovirus and the transmembrane domain as well as the luminal domain of a F protein of a parainfluenza virus.*

Either a live recombinant viral vaccine or an inactivated recombinant viral vaccine can be formulated. A live vaccine may be preferred because multiplication in the host leads to a prolonged stimulus of similar kind and magnitude to that occurring in natural infections, and therefore, confers substantial, long-lasting immunity. Production of such live recombinant virus vaccine formulations may be accomplished using conventional methods involving propagation of the virus in cell culture or in the allantois of the chick embryo followed by purification.

In a specific embodiment, the recombinant virus is non-pathogenic to the subject to which it is administered. In this regard, the use of genetically engineered viruses for vaccine purposes may desire the presence of attenuation characteristics in these strains. The introduction of appropriate mutations (e.g., deletions) into the templates used for transfection may provide the novel viruses with attenuation characteristics. For example, specific missense mutations which are associated with temperature sensitivity or cold adaption can be made into deletion mutations. These mutations should be more stable than the point mutations associated with cold or temperature sensitive mutants and reversion frequencies should be extremely low.

Alternatively, chimeric viruses with "suicide" characteristics may be constructed. Such viruses would go through only one or a few rounds of replication within the host. When used as a vaccine, the recombinant virus would go through limited replication cycle(s) and induce a sufficient level of immune response but it would not go further in the human host and cause disease. Recombinant viruses lacking one or more of the genes of wild type APV and hMPV, respectively, or possessing mutated genes as compared to the wild type strains would not be able to undergo successive rounds of replication. Defective viruses can be produced in cell lines which permanently express such a gene(s). Viruses lacking an essential gene(s) will be replicated in these cell lines but when administered to the human host will not be able to complete a round of replication. Such preparations may transcribe and translate—in this abortive cycle—a sufficient number of genes to induce an immune response. Alternatively, larger quantities of the strains could be administered, so that these preparations serve as inactivated (killed) virus vaccines. For inactivated vaccines, it is preferred that the heterologous gene product be expressed as a viral component, so that the gene product is associated with the virion. The advantage of such preparations is that they contain native proteins and do not undergo inactivation by treatment with formalin or other agents used in the manufacturing of killed virus vaccines. Alternatively, recombinant virus of the invention made from cDNA may be highly attenuated so that it replicates for only a few rounds.

In certain embodiments, the vaccine of the invention comprises an attenuated mammalian MPV. Without being bound by theory, the attenuated virus can be effective as a vaccine even if the attenuated virus is incapable of causing a cell to generate new infectious viral particles because the viral proteins are inserted in the cytoplasmic membrane of the host thus stimulating an immune response.

In another embodiment of this aspect of the invention, inactivated vaccine formulations may be prepared using conventional techniques to "kill" the chimeric viruses. Inactivated vaccines are "dead" in the sense that their infectivity has been destroyed. Ideally, the infectivity of the virus is destroyed without affecting its immunogenicity. In order to prepare inactivated vaccines, the chimeric virus may be grown in cell culture or in the allantois of the chick embryo, purified by zonal ultracentrifugation, inactivated by formaldehyde or β-propiolactone, and pooled. The resulting vaccine is usually inoculated intramuscularly.

Inactivated viruses may be formulated with a suitable adjuvant in order to enhance the immunological response. Such adjuvants may include but are not limited to mineral gels, e.g., aluminum hydroxide; surface active substances such as lysolecithin, pluronic polyols, polyanions; peptides; oil emulsions; and potentially useful human adjuvants such as BCG, *Corynebacterium parvum*, ISCOMS and virosomes.

Many methods may be used to introduce the vaccine formulations described above, these include but are not limited to oral, intradermal, intramuscular, intraperitoneal, intravenous, subcutaneous, percutaneous, and intranasal and inhalation routes. It may be preferable to introduce the chimeric virus vaccine formulation via the natural route of infection of the pathogen for which the vaccine is designed.

In certain embodiments, the invention relates to immunogenic compositions. The immunogenic compositions comprise a mammalian MPV. In a specific embodiment, the immunogenic composition comprises a human MPV. In certain embodiments, the immunogenic composition comprises an attenuated mammalian MPV or an attenuated human MPV. In certain embodiments, the immunogenic composition further comprises a pharmaceutically acceptable carrier.

5.13 Dosage Regimens, Administration and Formulations

The present invention provides vaccines and immunogenic preparations comprising MPV and APV, including attenuated forms of the virus, recombinant forms of MPV and APV, and chimeric MPV and APV expressing one or more heterologous or non-native antigenic sequences. The vaccines or immunogenic preparations of the invention encompass single or multivalent vaccines, including bivalent and trivalent vaccines. The vaccines or immunogenic formulations of the invention are useful in providing protections against various viral infections. Particularly, the vaccines or immunogenic formulations of the invention provide protection against respiratory tract infections in a host.

A recombinant virus and/or a vaccine or immunogenic formulation of the invention can be administered alone or in combination with other vaccines. Preferably, a vaccine or immunogenic formulation of the invention is administered in combination with other vaccines or immunogenic formulations that provide protection against respiratory tract diseases, such as but not limited to, respiratory syncytial virus vaccines, influenza vaccines, measles vaccines, mumps vaccines, rubella vaccines, pneumococcal vaccines, rickettsia vaccines, staphylococcus vaccines, whooping cough vaccines or vaccines against respiratory tract cancers. In a preferred embodiment, the virus and/or vaccine of the invention is administered concurrently with pediatric vaccines recommended at the corresponding ages. For example, at two, four or six months of age, the virus and/or vaccine of the invention can be administered concurrently with DtaP (IM), Hib (IM), Polio (IPV or OPV) and Hepatitis B (IM). At twelve or fifteen months of age, the virus and/or vaccine of the invention can be administered concurrently with Hib (IM), Polio (IPV or OPV), MMRII® (SubQ); Varivax® (SubQ), and hepatitis B (IM). The vaccines that can be used with the methods of invention are reviewed in various publications, e.g., The Jordan Report 2000, Division of Microbiology and Infectious Diseases, National Institute of Allergy and Infectious Diseases, National Institutes of Health, United States, the content of which is incorporated herein by reference in its entirety.

A vaccine or immunogenic formulation of the invention may be administered to a subject per se or in the form of a pharmaceutical or therapeutic composition. Pharmaceutical compositions comprising an adjuvant and an immunogenic antigen of the invention (e.g., a virus, a chimeric virus, a mutated virus) may be manufactured by means of conventional mixing, dissolving, granulating, dragee-making, levigating, emulsifying, encapsulating, entrapping or lyophilizing processes. Pharmaceutical compositions may be formulated in conventional manner using one or more physiologically acceptable carriers, diluents, excipients or auxiliaries which facilitate processing of the immunogenic antigen of the invention into preparations which can be used pharmaceutically. Proper formulation is, amongst others, dependent upon the route of administration chosen.

When a vaccine or immunogenic composition of the invention comprises adjuvants or is administered together with one or more adjuvants, the adjuvants that can be used include, but are not limited to, mineral salt adjuvants or mineral salt gel adjuvants, particulate adjuvants, microparticulate adjuvants, mucosal adjuvants, and immunostimulatory adjuvants. Examples of adjuvants include, but are not limited to, aluminum hydroxide, aluminum phosphate gel, Freund's Complete Adjuvant, Freund's Incomplete Adjuvant, squalene or squalane oil-in-water adjuvant formulations, biodegradable and biocompatible polyesters, polymerized liposomes, triterpenoid glycosides or saponins (e.g., QuilA and QS-21, also sold under the trademark STIMULON, ISCOPREP), N-acetyl-muramyl-L-threonyl-D-isoglutamine (Threonyl-MDP, sold under the trademark TERMURTIDE), LPS, monophosphoryl Lipid A (3D-MLA sold under the trademark MPL).

The subject to which the vaccine or an immunogenic composition of the invention is administered is preferably a mammal, most preferably a human, but can also be a non-human animal, including but not limited to, primates, cows, horses, sheep, pigs, fowl (e.g., chickens, turkeys), goats, cats, dogs, hamsters, mice and rodents.

Many methods may be used to introduce the vaccine or the immunogenic composition of the invention, including but not limited to, oral, intradermal, intramuscular, intraperitoneal, intravenous, subcutaneous, percutaneous, intranasal and inhalation routes, and via scarification (scratching through the top layers of skin, e.g., using a bifurcated needle).

For topical administration, the vaccine or immunogenic preparations of the invention may be formulated as solutions, gels, ointments, creams, suspensions, etc. as are well-known in the art.

For administration intranasally or by inhalation, the preparation for use according to the present invention can be conveniently delivered in the form of an aerosol spray presentation from pressurized packs or a nebulizer, with the use of a suitable propellant, e.g., dichlorodifluoromethane, trichlorofluoromethane, dichlorotetrafluoroethane, carbon dioxide or other suitable gas. In the case of a pressurized aerosol the dosage unit may be determined by providing a valve to deliver a metered amount. Capsules and cartridges of, e.g., gelatin for use in an inhaler or insufflator may be formulated containing a powder mix of the compound and a suitable powder base such as lactose or starch.

For injection, the vaccine or immunogenic preparations may be formulated in aqueous solutions, preferably in physiologically compatible buffers such as Hanks's solution, Ringer's solution, or physiological saline buffer. The solution may contain fonmulatory agents such as suspending, stabilizing and/or dispersing agents. Alternatively, the proteins may be in powder form for constitution with a suitable vehicle, e.g., sterile pyrogen-free water, before use.

Determination of an effective amount of the vaccine or immunogenic formulation for administration is well within the capabilities of those skilled in the art, especially in light of the detailed disclosure provided herein.

An effective dose can be estimated initially from in vitro assays. For example, a dose can be formulated in animal models to achieve an induction of an immunity response using techniques that are well known in the art. One having ordinary skill in the art could readily optimize administration to all animal species based on results described herein. Dosage amount and interval may be adjusted individually. For example, when used as an immunogenic composition, a suitable dose is an amount of the composition that when administered as described above, is capable of eliciting an antibody response. When used as a vaccine, the vaccine or immunogenic formulations of the invention may be administered in about 1 to 3 doses for a 1-36 week period. Preferably, 1 or 2 doses are administered, at intervals of about 2 weeks to about 4 months, and booster vaccinations may be given periodically thereafter. Alternate protocols may be appropriate for individual animals. A suitable dose is an amount of the vaccine formulation that, when administered as described above, is capable of raising an immunity response in an immunized animal sufficient to protect the animal from an infection for at least 4 to 12 months. In general, the amount of the antigen present in a dose ranges from about 1 pg to about 100 mg per kg of host, typically from about 10 pg to about 1 mg, and preferably from about 100 pg to about 1 µg. Suitable dose range will vary with the route of injection and the size of the patient, but will typically range from about 0.1 mL to about 5 mL.

In a specific embodiment, the viruses and/or vaccines of the invention are administered at a starting single dose of at least $10^3$ $TCID_{50}$, at least $10^4$ $TCID_{50}$, at least $10^5$ $TCID_{50}$, at least $10^6$ $TCID_{50}$. In another specific embodiment, the virus and/or vaccines of the invention are administered at multiple doses. In a preferred embodiment, a primary dosing regimen at 2, 4, and 6 months of age and a booster dose at the beginning of the second year of life are used. More preferably, each dose of at least $10^5$ TCID$_{50}$, or at least $10^6$ TCID$^{50}$ is given in a multiple dosing regimen.

5.13.1 Challenge Studies

This assay is used to determine the ability of the recombinant viruses of the invention and of the vaccines of the invention to prevent lower respiratory tract viral infection in an animal model system, such as, but not limited to, cotton rats or hamsters. The recombinant virus and/or the vaccine can be administered by intravenous (IV) route, by intramuscular (IM) route or by intranasal route (IN). The recombinant virus and/or the vaccine can be administered by any technique well-known to the skilled artisan. This assay is also used to correlate the serum concentration of antibodies with a reduction in lung titer of the virus to which the antibodies bind.

On day 0, groups of animals, such as, but not limited to, cotton rats (*Sigmodon hispidis*, average weight 100 g) cynomolgous macacques (average weight 2.0 kg) are administered the recombinant or chimeric virus or the vaccine of interest or BSA by intramuscular injection, by intravenous injection, or by intranasal route. Prior to, concurrently with, or subsequent to administration of the recombinant virus or the vaccine of the invention, the animals are infected with wild type virus wherein the wild type virus is the virus against which the vaccine was generated. In certain embodiments, the animals are infected with the wild type virus at least 1 day, at least 2 days, at least 3 days, at least 4 days, at least 5 days, at least 6 days, 1 week or 1 or more months subsequent to the administration of the recombinant virus and/or the vaccine of the invention.

After the infection, cotton rats are sacrificed, and their lung tissue is harvested and pulmonary virus titers are determined by plaque titration. Bovine serum albumin (BSA) 10 mg/kg is used as a negative control. Antibody concentrations in the serum at the time of challenge are determined using a sandwich ELISA. Similarly, in macacques, virus titers in nasal and lung lavages can be measured.

5.13.2 Target Populations

In certain embodiments of the invention, the target population for the therapeutic and diagnostic methods of the invention is defined by age. In certain embodiments, the target population for the therapeutic and/or diagnostic methods of the invention is characterized by a disease or disorder in addition to a respiratory tract infection.

In a specific embodiment, the target population encompasses young children, below 2 years of age. In a more specific embodiment, the children below the age of 2 years do not suffer from illnesses other than respiratory tract infection.

In other embodiments, the target population encompasses patients above 5 years of age. In a more specific embodiment, the patients above the age of 5 years suffer from an additional disease or disorder including cystic fibrosis, leukaemia, and non-Hodgkin lymphoma, or recently received bone marrow or kidney transplantation.

In a specific embodiment of the invention, the target population encompasses subjects in which the hMPV infection is associated with immunosuppression of the hosts. In a specific embodiment, the subject is an immunocompromised individual.

In certain embodiments, the target population for the methods of the invention encompasses the elderly.

In a specific embodiment, the subject to be treated or diagnosed with the methods of the invention was infected with hMPV in the winter months.

5.13.3 Clinical Trials

Vaccines of the invention or fragments thereof tested in in vitro assays and animal models may be further evaluated for safety, tolerance and pharmacokinetics in groups of normal healthy adult volunteers. The volunteers are administered intramuscularly, intravenously or by a pulmonary delivery system a single dose of a recombinant virus of the invention and/or a vaccine of the invention. Each volunteer is monitored at least 24 hours prior to receiving the single dose of the recombinant virus of the invention and/or a vaccine of the invention and each volunteer will be monitored for at least 48 hours after receiving the dose at a clinical site. Then volunteers are monitored as outpatients on days 3, 7, 14, 21, 28, 35, 42, 49, and 56 postdose.

Blood samples are collected via an indwelling catheter or direct venipuncture using 10 ml red-top Vacutainer tubes at the following intervals: (1) prior to administering the dose of the recombinant virus of the invention and/or a vaccine of the invention; (2) during the administration of the dose of the recombinant virus of the invention and/or a vaccine of the invention; (3) 5 minutes, 10 minutes, 15 minutes, 20 minutes, 30 minutes, 1 hour, 2 hours, 4 hours, 8 hours, 12 hours, 24 hours, and 48 hours after administering the dose of the recombinant virus of the invention and/or a vaccine of the invention; and (4) 3 days, 7 days 14 days, 21 days, 28 days, 35 days, 42 days, 49 days, and 56 days after administering the dose of the recombinant virus of the invention and/or a vaccine of the invention. Samples are allowed to clot at room temperature and serum will be collected after centrifugation.

The amount of antibodies generated against the recombinant virus of the invention and/or a vaccine of the invention in the samples from the patients can be quantitated by ELISA. T-cell immunity (cytotoxic and helper responses) in PBMC and lung and nasal lavages can also be monitored.

The concentration of antibody levels in the serum of volunteers are corrected by subtracting the predose serum level (background level) from the serum levels at each collection interval after administration of the dose of recombinant virus of the invention and/or a vaccine of the invention. For each volunteer the pharmacokinetic parameters are computed according to the model-independent approach (Gibaldi et al., eds., 1982, Pharmacokinetics, 2nd edition, Marcel Dekker, New York) from the corrected serum antibody or antibody fragment concentrations.

5.14 Methods for Detecting and Diagnosing Mammalian MPV

The invention provides means and methods for the diagnosis and/or detection of MPV, said means and methods to be employed in the detection of MPV, its components, and the products of its transcription, translation, expression, propagation, and metabolic processes. More specifically, this invention provides means and methods for the diagnosis of an MPV infection in animals and in humans, said means and methods including but not limited to the detection of components of MPV, products of the life cycle of MPV, and products of a host's response to MPV exposure or infection.

In one embodiment, the invention provides means and methods for the diagnosis and detection of MPV, said means and methods including but not limited to the detection of genomic material and other nucleic acids that are associated with or complimentary to MPV, the detection of transcriptional and translational products of MPV, said products being both processed and unprocessed, and the detection of components of a host response to MPV exposure or infection.

In one embodiment, the invention relates to the detection of MPV through the preparation and use of oligonucleotides that are complimentary to nucleic acid sequences and transcriptional products of nucleic acid sequences that are present within the genome of MPV. Furthermore, the invention relates to the detection of nucleic acids, or sequences thereof, that are present in the genome of MPV and its transcription products, using said oligonucleotides as primers for copying or amplification of specific regions of the MPV genome and its transcripts. The regions of the MPV genome and its transcripts that can be copied or amplified include but are not limited to complete and incomplete stretches of one or more of the following: the N-gene, the P-gene, the M-gene, the F-gene, the M2-gene, the SH-gene, the G-gene, and the L-gene. In a specific embodiment, oligonucleotides are used as primers in conjunction with methods to copy or amplify the N-gene of MPV, or transcripts thereof, for identification purposes. Said methods include but are not limited to RT-PCR assays, primer extension or run on assays, and other methods that employ the genetic material of MPV or transcripts and compliments thereof as templates for the extension of nucleic acid sequences from said oligonucleotides.

In another embodiment, the invention relates to detection of MPV through the preparation and use of oligonucleotides that are complimentary to nucleic acid sequences and transcriptional products of nucleic acid sequences that are present within the genome of MPV. Furthermore, the invention relates to the detection of nucleic acids, or sequences thereof, that are present in or complimentary to the genome of MPV and its transcription products, using said oligonucleotide sequences as probes for hybridization to and detection of specific regions within or complimentary to the MPV genome and its transcripts. The regions of the MPV genome and its transcripts that can be detected using hybridization probes include but are not limited to complete and incomplete stretches of one or more of the following: the N-gene, the P-gene, the M-gene, the F-gene, the M2-gene, the SH-gene, the G-gene, and the L-gene. In a specific embodiment, oligonucleotides are used as probes in conjunction with methods to detect, anneal, or hybridize to the N-gene of MPV, or transcripts thereof, for identification purposes. Said methods include but are not limited to, Northern blots, Southern blots and other methods that employ the genetic material of MPV or transcripts and compliments thereof as targets for the hybridization, annealing, or detection of sequences or stretches of sequences within or complimentary to the MPV genome.

A nucleic acid which is hybridizable to a nucleic acid of a mammalian MPV, or to its reverse complement, or to its complement can be used in the methods of the invention to detect the presence of a mammalian MPV. In certain embodiments, the nucleic acids are hybridized under conditions of high stringency. By way of example and not limitation, procedures using such conditions of high stringency are as follows. Prehybridization of filters containing DNA is carried out for 8 h to overnight at 65 C in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 h at 65 C in prehybridization mixture containing 100 μg/ml denatured salmon sperm DNA and 5-20×106 cpm of 32P-labeled probe. Washing of filters is done at 37 C for 1 h in a solution containing 2×SSC, 0.01% PVP, 0.01% Ficoll, and 0.01% BSA. This is followed by a wash in 0.1×SSC at 50 C for 45 min before autoradiography. Other conditions of high stringency which may be used are well known in the art. In other embodiments of the invention, hybridization is performed under moderate of low stringency conditions, such conditions are well-known to the skilled artisan (see e.g., Sambrook et al., 1989, Molecular Cloning, A Laboratory Manual, 2d Ed., Cold Spring Harbor Laboratory Press, Cold Spring Harbor, N.Y.; see also, Ausubel et al., eds., in the Current Protocols in Molecular Biology series of laboratory technique manuals, 1987-1997 Current Protocols,© 1994-1997 John Wiley and Sons, Inc.).

In another embodiment, the invention relates to the detection of an MPV infection in an animal or human host through the preparation and use of antibodies, e.g., monoclonal antibodies (MAbs), that are specific to and can recognize peptides or nucleic acids that are characteristic of MPV or its gene products. The epitopes or antigenic determinants recognized by said MAbs include but are not limited to proteinaceous and nucleic acid products that are synthesized during the life cycle and metabolic processes involved in MPV propagation. The proteinaceous or nucleic acid products that can be used as antigenic determinants for the generation of suitable antibodies include but are not limited to complete and incomplete transcription and expression products of one or more of the following components of MPV: the N-gene, the P-gene, the M-gene, the F-gene, the M2-gene, the SH-gene, the G-gene, and the L-gene. In one specific embodiment, MAbs raised against proteinaccous products of the G-gene or portions thereof are used in conjunction with other methods to detect or confirm the presence of the MPV expressed G peptide in a biological sample, e.g. body fluid. Said methods include but are not limited to ELISA, Radio-Immuno or Competition Assays, Immuno-precipitation and other methods that employ the transcribed or expressed gene products of MPV as targets for detection by MAbs raised against said targets or portions and relatives thereof.

In another embodiment, the invention relates to the detection of factors that are associated with and characteristic of a host's immunologic response to MPV exposure or infection. Upon exposure or infection by MPV, a host's immune system illicits a response to said exposure or infection that involves the generation by the host of antibodies directed at eliminating or attenuating the effects and/or propagation of virus. This invention provides means and methods for the diagnosis of MPV related disease through the detection of said antibodies that may be produced as a result of MPV exposure to or infection of the host. The epitopes recognized by said antibodies include but are not limited to peptides and their exposed surfaces that are accessible to a host immune response and that can serve as antigenic determinants in the generation of an immune response by the host to the virus. Some of the proteinaceous and nuclear material used by a host immune response as epitopes for the generation of antibodies include but are not limited to products of one or more of the following components of MPV: the N-gene, the P-gene, the M-gene, the F-gene, the M2-gene, the SH-gene, the G-gene, and the L-gene. In one embodiment, antibodies to partially or completely accessible portions of the N-gene encoded peptides of MPV are detected in a host sample. In a specific embodiment, proteinaceous products of the G-gene or portions thereof are used in conjunction with other methods to detect the presence of the host derived antibodies in a biological sample, e.g. body fluid. Said methods include but are not limited to ELISA, Radio-Immuno or Competition Assays, and other methods that employ the transcribed or expressed gene products of MPV as targets for detection by host antibodies that recognize said products and that are found in biological samples.

This invention also provides means and methods for diagnostic assays or test kits and for methods to detect agents of an MPV infection from a variety of sources including but not limited to biological samples, e.g., body fluids. In one embodiment, this invention relates to assays, kits, protocols, and procedures that are suitable for identifying an MPV nucleic acid or a compliment thereof. In another embodiment, this invention relates to assays, kits, protocols, and procedures that are suitable for identifying an MPV expressed peptide or a portion thereof. In another embodiment, this invention relates to assays, kits, protocols, and procedures that are suitable for identifying components of a host immunologic response to MPV exposure or infection.

In addition to diagnostic confirmation of MPV infection of a host, the present invention also provides for means and methods to classify isolates of MPV into distinct phylogenetic groups or subgroups. In one embodiment, this feature can be used advantageously to distinguish between the different variant of MPV, variant A1, A2, B1 and B2, in order to design more effective and subgroup specific therapies. Variants of MPV can be differentiated on the basis of nucleotide or amino acid sequences of one or more of the following: the N-gene, the P-gene, the M-gene, the F-gene, the M2-gene, the SH-gene, the G-gene, and the L-gene. In a specific embodiment, MPV can be differentiated into a specific subgroup using the nucleotide or amino acid sequence of the G gene or glycoprotein and neutralization tests using monoclonal antibodies that also recognize the G glycoprotein.

In one embodiment, the diagnosis of an MPV infection in a human is made using any technique well known to one skilled in the art, e.g., immunoassays. Immunoassays which can be used to analyze immunospecific binding and cross-reactivity include, but are not limited to, competitive and non-competitive assay systems using techniques such as westem blots, radioimmunoassays, ELISA (enzyme linked immunosorbent assay), sandwich immunoassays, immunoprecipitation assays, precipitin reactions, gel diffusion precipitation reactions, immunodiffusion assays, agglutination assays, complement-fixation assays, and fluorescent immunoassays, to name but a few. Such assays are routine and well known in the art (see, e.g., Ausubel et al., eds, 1994, Current Protocols in Molecular Biology, Vol. 1, John Wiley & Sons, Inc., New York, which is incorporated by reference herein in its entirety) and non-limiting examples of immunoassays are described in section 5.8.

In one embodiment, the invention relates to the detection of an MPV infection using oligonucleotides in conjunction with PCR or primer extension methods to copy or amplify regions of the MPV genome, said regions including but not limited to genes or parts of genes, e.g., the N, M, F, G, L, M, P, and M2 genes. In a specific embodiment, oligonucleotides are used in conjunction with RT-PCR methods. In a further embodiment, the amplification products and/or genetic material can be probed with oligonucleotides that are complimentary to specific sequences that are either conserved between various hMPV strains or are distinct amongst various hMPV strains. The latter set of oligonucletides would allow for identification of the specific strain of hMPV responsible for the infection of the host.

The invention provides methods for distinguishing-between different subgroups and variants of hMPV that are capable of infecting a host. In one specific embodiment, the hMPV that is responsible for a host infection is classified into a specific subgroup, e.g., subgroup A or subgroup B. In another specific embodiment, the hMPV that is responsible for a host infection is classified as a specific variant of a subgroup, e.g., variant A1, A2, B1, or B2. In another embodiment, the invention provides means and methods for the classification of an hMPV that is responsible for a host infection into a new subgroup and/or into a new variant of a new or existing subgroup. The methods that are able to distinguish hMPV strains into subgroups and/or variant groups would be known to one skilled in the art. In one embodiment, a polyclonal antibody is used to identify the etiological agent of an infection as a strain of hMPV, and a secondary antibody is used to distinguish said strain as characteristic of a new or known subgroup and/or new or known variant of hMPV. In one embodiment, antibodies that are selective for hMPV are used in conjunction with immunoreactive assays, e.g. ELISA or RIA, to identify the presence of hMPV exposure or infection in biological samples. In a further embodiment, secondary antibodies that are selective for specific epitopes in the peptide sequence of hMPV proteins are used to further classify the etiological agents of said identified hMPV infections into subgroups or variants. In one specific embodiment, an antibody raised against peptide epitopes that are shared between all subgroups of hMPV is used to identify the etiological agent of an infection as an hMPV. In a further specific embodiment, antibodies raised against peptide epitopes that are unique to the different subgroups and/or variants of hMPV are used to classify the hMPV that is responsible for the host infection into a known or new subgroup and/or variant. In one specific embodiment, the antibody that is capable of distinguishing between different subgroups and/or variants of hMPV recognizes segments of hMPV peptides that are unique to the subgroup or variant, said peptides including but not limited to those encoded by the N, M, F, G, L, M, P, and M2 genes. The peptides or segments of peptides that can be used to generate antibodies capable of distinghishing between different hMPV sugroups or variants can be selected using differences in known peptide sequences of various hMPV proteins in conjunction with hydrophillicity plots to identify suitable peptide segments that would be expected to be solvent exposed or accessible in a diagnostic assay. In one embodiment, the antibody that is capable of distinguishing between the different subgroups of hMPV recongnizes differences in the F protein that are unique to different subgroups of hMPV, e.g. the amino acids at positions 286, 296, 312, 348, and 404 of the full length F protein. In another specific embodiment, the antibody that is capable of distinguishing between different subgroups and/or variants of hMPV recognizes segments of the G protein of hMPV that are unique to specific subgroups or variants, e.g., the G peptide sequence corresponding to amino acids 50 through 60 of SEQ ID:119 can be used to distinguish between subgroups A and B as well as between variants A1, A2, B1, and B2. In another embodiment of the invention, the nucleotide sequence of hMPV isolates are used to distinguish between different subgroups and/or different variants of hMPV. In one embodiment, oligonucleotide sequences, primers, and/or probes that are complimentary to sequences in the hMPV genome are used to classify the etiological agents of hMPV infections into distinct subgroups and/or variants in conjunction with methods known to one skilled in the art, e.g. RT-PCR, PCR, primer run on assays, and various blotting techniques. In one specific embodiment, a biological sample is used to copy or amplify a specific segment of the hMPV genome, using RT-PCR. In a further embodiment, the sequence of said segment is obtained and compared with known sequences of hMPV, and said comparison is used to classify the hMPV strain into a distinct subgroup or variant or to classify the hMPV strain into a new subgroup or variant. In another embodiment, the invention relates to diagnostic kits that can be used to distinguish between different subgroups and/or variants of hMPV.

In a preferred embodiment, diagnosis and/or treatment of a specific viral infection is performed with reagents that are most specific for said specific virus causing said infection. In this case this means that it is preferred that said diagnosis and/or treatment of an MPV infection is performed with reagents that are most specific for MPV. This by no means however excludes the possibility that less specific, but sufficiently crossreactive reagents are used instead, for example because they are more easily available and sufficiently address the task at hand. Herein it is for example provided to perform virological and/or serological diagnosis of MPV infections in mammals with reagents derived from APV, in particular with reagents derived from APV-C, in the detailed description herein it is for example shown that sufficiently trustworthy serological diagnosis of MPV infections in mammals can be achieved by using an ELISA specifically designed to detect APV antibodies in birds. A particular useful test for this purpose is an ELISA test designed for the detection of APV antibodies (e.g in serum or egg yolk), one commercially available version of which is known as APV-Ab SVANOVIR® which is manufactured by SVANOVA Biotech AB, Uppsal Science Park Glunten SE-751 83 Uppsala Sweden. The reverse situation is also the case, herein it is for example provided to perform virological and/or serological diagnosis of APV infections in mammals with reagents derived from MPV, in the detailed description herein it is for example shown that sufficiently trustworthy serological diagnosis of APV infections in birds can be achieved by using an ELISA designed to detect MPV antibodies. Considering that antigens and antibodies have a lock-and-key relationship, detection of the various antigens can be achieved by selecting the appropriate antibody having sufficient cross-reactivity. Of course, for relying on such cross-reactivity, it is best to select the reagents (such as antigens or antibodies) under guidance of the amino acid homologies that exist between the various (glyco)proteins of the various viruses, whereby reagents relating to the most homologous proteins will be most useful to be used in tests relying on said cross-reactivity.

For nucleic acid detection, it is even more straightforward, instead of designing primers or probes based on heterologous nucleic acid sequences of the various viruses and thus that detect differences between the essentially mammalian or avian Metapneumoviruses, it suffices to design or select primers or probes based on those stretches of virus-specific nucleic acid sequences that show high homology. In general, for nucleic acid sequences, homology percentages of 90% or higher guarantee sufficient cross-reactivity to be relied upon in diagnostic tests utilizing stringent conditions of hybridisation.

The invention for example provides a method for virologically diagnosing a MPV infection of an animal, in particular of a mammal, more in particular of a human being, comprising determining in a sample of said animal the presence of a viral isolate or component thereof by reacting said sample with a MPV specific nucleic acid a or antibody according to the invention, and a method for serologically diagnosing an MPV infection of a mammal comprising determining in a sample of said mammal the presence of an antibody specifically directed against an MPV or component thereof by reacting said sample with a MPV-specific proteinaceous molecule or fragment thereof or an antigen according to the invention. The invention also provides a diagnostic kit for diagnosing an MPV infection comprising an MPV, an MPV-specific nucleic acid, proteinaceous molecule or fragment thereof, antigen and/or an antibody according to the invention, and preferably a means for detecting said MPV, MPV-specific nucleic acid, proteinaceous molecule or fragment thereof, antigen and/or an antibody, said means for example comprising an excitable group such as a fluorophore or enzymatic detection system used in the art (examples of suitable diagnostic kit format comprise IF, ELISA, neutralization assay, RT-PCR assay). To determine whether an as yet unidentified virus component or synthetic analogue thereof such as nucleic acid, proteinaceous molecule or fragment thereof can be identified as MPV-specific, it suffices to analyse the nucleic acid or amino acid sequence of said component, for example for a stretch of said nucleic acid or amino acid, preferably of at least 10, more preferably at least 25, more preferably at least 40 nucleotides or amino acids (respectively), by sequence homology comparison with known MPV sequences and with known non-MPV sequences APV-C is preferably used) using for example phylogenetic analyses as provided herein. Depending on the degree of relationship with said MPV or non-MPV sequences, the component or synthetic analogue can be identified.

The invention also provides method for virologically diagnosing an MPV infection of a mammal comprising determining in a sample of said mammal the presence of a viral isolate or component thereof by reacting said sample with a cross-reactive nucleic acid derived from APV (preferably serotype C) or a cross-reactive antibody reactive with said APV, and a method for serologically diagnosing an MPV infection of a mammal comprising determining in a sample of said mammal the presence of a cross-reactive antibody that is also directed against an APV or component thereof by reacting said sample with a proteinaceous molecule or fragment thereof or an antigen derived from APV. Furthermore, the invention provides the use of a diagnostic kit initially designed for AVP or AVP-antibody detection for diagnosing an MPV infection, in particular for detecting said MPV infection in humans.

The invention also provides methods for virologically diagnosing an APV infection in a bird comprising determining in a sample of said bird the presence of a viral isolate or component thereof by reacting said sample with a cross-reactive nucleic acid derived from MPV or a cross-reactive antibody reactive with said MPV, and a method for serologically diagnosing an APV infection of a bird comprising determining in a sample of said bird the presence of a cross-reactive antibody that is also directed against an MPV or component thereof by reacting said sample with a proteinaceous molecule or fragment thereof or an antigen derived from MPV. Furthermore, the invention provides the use of a diagnostic kit initially designed for MPV or MPV-antibody detection for diagnosing an APV infection, in particular for detecting said APV infection in poultry such as a chicken, duck or turkey.

For diagnosis as for treatment, use can be made of the high degree of homology among different mammalian MPVs and between MPV and other viruses, such as, e.g., APV, in particular when circumstances at hand make the use of the more homologous approach less straightforward. Vaccinations that can not wait, such as emergency vaccinations against MPV infections can for example be performed with vaccine preparations derived from APV(preferably type C) isolates when a more homologous MPV vaccine is not available, and, vice versa, vaccinations against APV infections can be contemplated with vaccine preparations derived from MPV. Also, reverse genetic techniques make it possible to generate chimeric APV-MPV virus constructs that are useful as a vaccine, being sufficiently dissimilar to field isolates of each of the respective strains to be attenuated to a desirable level. Similar reverse genetic techniques will make it also possible to generate chimeric paramyxovirus-*metapnuemovirus* constructs, such as RSV-MPV or P13-MPV constructs for us in a vaccine preparation. Such constructs are particularly useful as a combination vaccine to combat respiratory tract illnesses.

Since MPV CPE was virtually indistinguishable from that caused by hRSV or hPIV-1 in tMK or other cell cultures, the MPV may have well gone unnoticed until now. tMK (tertiary monkey kidney cells, i.e. MK cells in a third passage in cell culture) are preferably used due to their lower costs in comparison to primary or secondary cultures. The CPE is, as well as with some of the classical Paraniyxovimidae, characterized by syncytium formation after which the cells showed rapid internal disruption, followed by detachment of the cells from the monolayer. The cells usually (but not always) displayed CPE after three passages of virus from original material, at day 10 to 14 post inoculation, somewhat later than CPE caused by other viruses such as hRSV or hPIV-1.

As an example, the invention provides a not previously identified paramyxovirus from nasopharyngeal aspirate samples taken from 28 children suffering from severe RTI. The clinical symptoms of these children were largely similar to those caused by hRSV. Twenty-seven of the patients were children below the age of five years and half of these were between 1 and 12 months old. The other patient was 18 years old. All individuals suffered from upper RTI, with symptoms ranging from cough, myalgia, vomiting and fever to broncheolitis and severe pneumonia. The majority of these patients were hospitalised for one to two weeks.

The virus isolates from these patients had the paramyxovirus morphology in negative contrast electron microscopy but did not react with specific antisera against known human and animal paramyxoviruses. They were all closely related to one another as determined by indirect immunofluorescence assays (IFA) with sera raised against two of the isolates. Sequence analyses of nine of these isolates revealed that the virus is somewhat related to APV. Based on virological data, sequence homology as well as the genomic organisation we propose that the virus is a member of *Metapneumovirus* genus. Serological surveys showed that this virus is a relatively common pathogen since the seroprevalence in the Netherlands approaches 100% of humans by the age of five years. Moreover, the seroprevalence was found to be equally high in sera collected from humans in 1958, indicating this virus has been circulating in the human population for more than 40 years. The identification of this proposed new member of the *Metapnuemovirus* genus now also provides for the development of means and methods for diagnostic assays or test kits and vaccines or serum or antibody compositions for viral respiratory tract infections, and for methods to test or screen for antiviral agents useful in the treatment of MPV infections.

Methods and means provided herein are particularly useful in a diagnostic kit for diagnosing a MPV infection, be it by virological or serological diagnosis. Such kits or assays may for example comprise a virus, a nucleic acid, a proteinaceous molecule or fragment thereof, an antigen and/or an antibody according to the invention. Use of a virus, a nucleic acid, a proteinaceous molecule or fragment thereof, an antigen and/or an antibody according to the invention is also provided for the production of a pharmaceutical composition, for example for the treatment or prevention of MPV infections and/or for the treatment or prevention of respiratory tract illnesses, in particular in humans. Attenuation of the virus can be achieved by established methods developed for this purpose, including but not limited to the use of related viruses of other species, serial passages through laboratory animals or/and tissue/cell cultures, site directed mutagenesis of molecular clones and exchange of genes or gene fragments between related viruses.

5.15 Compositions of the Invention and Components of Mammalian *Metapnuemovirus*

The invention relates to nucleic acid sequences of a mammalian MPV, proteins of a mammalian MPV, and antibodies against proteins of a mammalian MPV. The invention further relates to homologs of nucleic acid sequences of a mammalian MPV and homologs of proteins of a mammalian MPV. The invention further relates to nucleic acid sequences encoding fusion proteins, wherein the fusion protein contains a protein of a mammalian MPV or a fragment thereof and one or more peptides or proteins that are not derived from mammalian MPV. In a specific embodiment, a fusion protein of the invention contains a protein of a mammalian MPV or a fragment thereof and a peptide tag, such as, but not limited to a polyhistidine tag. The invention further relates to fusion proteins, wherein the fusion protein contains a protein of a mammalian MPV or a fragment thereof and one or more peptides or proteins that are not derived from mammalian MPV. The invention also relates to derivatives of nucleic acids encoding a protein of a mammlian MPV. The invention also relates to derivatives of proteins of a mammalian MPV. A derivative can be, but is not limited to, mutant forms of the protein, such as, but not limited to, additions, deletions, truncations, substitutions, and inversions. A derivative can further be a chimeric form of the protein of the mammalian MPV, wherein at least one domain of the protein is derived from a different protein. A derivative can also be a form of a protein of a mammalian MPV that is covalently or non-covalently linked to another molecule, such as, e.g., a drug.

The viral isolate termed NL/1/00 (also 00-1) is a mammalian MPV of variant A1 and its genomic sequence is shown in SEQ ID NO:19. The viral isolate termed NL/17/00 is a mammalian MPV of variant A2 and its genomic sequence is shown in SEQ ID NO:20. The viral isolate termed NL/1/99 (also 99-1) is a mammalian MPV of variant B1 and its genomic sequence is shown in SEQ ID NO:18. The viral isolate tenned NL/1/94 is a mammalian MPV of variant B2 and its genomic sequence is shown in SEQ ID NO:21. A list of sequences disclosed in the present application and the corresponding SEQ ID Nos is set forth in Table 14.

The protein of a mammalian MPV can be a an N protein, a P protein, a M protein, a F protein, a M2-1 protein or a M2-2 protein or a fragment thereof. A fragment of a protein of a mammlian MPV can be can be at least 25 amino acids, at least 50 amino acids, at least 75 amino acids, at least 100 amino acids, at least 125 amino acids, at least 150 amino acids, at least 175 amino acids, at least 200 amino acids, at least 225 amino acids, at least 250 amino acids, at least 275 amino acids, at least 300 amino acids, at least 325 amino acids, at least 350 amino acids, at least 375 amino acids, at least 400 amino acids, at least 425 amino acids, at least 450 amino acids, at least 475 amino acids, at least 500 amino acids, at least 750 amino acids, at least 1000 amino acids, at least 1250 amino acids, at least 1500 amino acids, at least 1750 amino acids, at least 2000 amino acids or at least 2250 amino acids in length. A fragment of a protein of a mammlian MPV can be can be at most 25 amino acids, at most 50 amino acids, at most 75 amino acids, at most 100 amino acids, at most 125 amino acids, at most 150 amino acids, at most 175 amino acids, at most 200 amino acids, at most 225 amino acids, at most 250 amino acids, at most 275 amino acids, at most 300 amino acids, at most 325 amino acids, at most 350 amino acids, at most 375 amino acids, at most 400 amino acids, at most 425 amino acids, at most 450 amino acids, at most 475 amino acids, at most 500 amino acids, at most 750 amino acids, at most 1000 amino acids, at most 1250 amino acids, at most 1500 amino acids, at most 1750 amino acids, at most 2000 amino acids or at most 2250 amino acids in length.

In certain embodiments of the invention, the protein of a mammalian MPV is a N protein, wherein the N protein is phylogenetically closer related to a N protein of a mammalian MPV, such as the N protein encoded by, e.g., the viral genome of SEQ ID NO:18, SEQ ID NO:19, SEQ ID NO:20, or SEQ ID NO:21, (see also Table 14 for a description of the SEQ ID Nos) than it is related to the N protein of APV type C. In certain embodiments of the invention, the protein of a mammalian MPV is a P protein, wherein the P protein is phylogenetically closer related to a P protein of a mammalian MPV, such as the P protein encoded by, e.g., the viral genome of SEQ ID NO:18, SEQ ID NO:19, SEQ ID NO:20, or SEQ ID NO:21, than it is related to the N protein of APV type C. In certain embodiments of the invention, the protein of a mammalian MPV is a M protein, wherein the M protein is closer related to a M protein of a mammalian MPV, such as the M protein encoded by, e.g., the viral genome of SEQ ID NO:18, SEQ ID NO:19, SEQ ID NO:20, or SEQ ID NO:21, than it is related to the M protein of APV type C. In certain embodiments of the invention, the protein of a mammalian MPV is a F protein, wherein the F protein is phylogenetically closer related to a F protein of a mammalian MPV, such as the F protein encoded by, e.g., the viral genome of SEQ ID NO:18, SEQ ID NO:19, SEQ ID NO:20, or SEQ ID NO:21, than it is related to the F protein of APV type C. In certain embodiments of the invention, the protein of a mammalian MPV is a M2-1 protein, wherein the M2-1 protein is phylogenetically closer related to a M2-1 protein of a mammalian MPV, such as the M2-1 protein encoded by, e.g., the viral genome of SEQ ID NO:18, SEQ ID NO:19, SEQ ID NO:20, or SEQ ID NO:21, than it is related to the M2-1 protein of APV type C. In certain embodiments of the invention, the protein of a mammalian MPV is a M2-2 protein, wherein the M2-2 protein is phylogenetically closer related to a M2-2 protein of a mammalian MPV, such as the M2-2 protein encoded by, e.g., the viral genome of SEQ ID NO:18, SEQ ID NO:19, SEQ ID NO:20, or SEQ ID NO:21, than it is related to the M2-2 protein of APV type C. In certain embodiments of the invention, the protein of a mammalian MPV is a G protein, wherein the G protein is phylogenetically closer related to a G protein of a mammalian MPV, such as the G protein encoded by, e.g., the viral genome of SEQ ID NO:18, SEQ ID NO:19, SEQ ID NO:20, or SEQ ID NO:21, than it is related to any protein of APV type C. In certain embodiments of the invention, the protein of a mammalian MPV is a SH protein, wherein the SH protein is phylogenetically closer related to a SH protein of a mammalian MPV, such as the SH protein encoded by, e.g., the viral genome of SEQ ID NO:18, SEQ ID NO:19, SEQ ID NO:20, or SEQ ID NO:21, than it is related to any protein of APV type C. In certain embodiments of the invention, the protein of a mammalian MPV is a L protein, wherein the L protein is phylogenetically closer related to a L protein of a mammalian MPV, such as the SH protein encoded by, e.g., the viral genome of SEQ ID NO:18, SEQ ID NO:19, SEQ ID NO:20, or SEQ ID NO:21, than it is related to any protein of APV type C.

In certain embodiments of the invention, the protein of a mammalian MPV is a N protein, wherein the N protein is at least 60%, at least 65%, at least 70%, at least 75%, at least 80%, at least 85%, at least 90%, at least 95%, at least 98%, at least 99%, or at least 99.5% identical to the amino acid sequence of a N protein encoded by the viral genome of SEQ ID NO:18, SEQ ID NO:19, SEQ ID NO:20, or SEQ ID NO:21 (the amino acid sequences of the respective N proteins are disclosed in SEQ ID NO:366-369; see also Table 14). In certain embodiments of the invention, the protein of a mammalian MPV is a N protein, wherein the P protein is at least 60%, at least 65%, at least 70%, at least 75%, at least 80%, at least 85%, at least 90%, at least 95%, at least 98%, at least 99%, or at least 99.5% identical to the amino acid sequence of a P protein encoded by the viral genome of SEQ ID NO:18, SEQ ID NO:19, SEQ ID NO:20, or SEQ ID NO:21 (the amino acid sequences of the respective P proteins are disclosed in SEQ ID NO:374-377; see also Table 14). In certain embodiments of the invention, the protein of a mammalian MPV is a M protein, wherein the M protein is at least 60%, at least 65%, at least 70%, at least 75%, at least 80%, at least 85%, at least 90%, at least 95%, at least 98%, at least 99%, or at least 99.5% identical to the amino acid sequence of a M protein encoded by the viral genome of SEQ ID NO:18, SEQ ID NO:19, SEQ ID NO:20, or SEQ ID NO:21 (the amino acid sequences of the respective M proteins are disclosed in SEQ ID NO:358-361; see also Table 14). In certain embodiments of the invention, the protein of a mammalian MPV is a F protein, wherein the F protein is at least 60%, at least 65%, at least 70%, at least 75%, at least 80%, at least 85%, at least 90%, at least 95%, at least 98%, at least 99%, or at least 99.5% identical to the amino acid sequence of a F protein encoded by the viral genome of SEQ ID NO:18, SEQ ID NO:19, SEQ ID NO:20, or SEQ ID NO:21 (the amino acid sequences of the respective F proteins are disclosed in SEQ ID NO:314-317; see also Table 14). In certain embodiments of the invention, the protein of a mammalian MPV is a M2-1 protein, wherein the M2-1 protein is at least 60%, at least 65%, at least 70%, at least 75%, at least 80%, at least 85%, at least 90%, at least 95%, at least 98%, at least 99%, or at least 99.5% identical to the amino acid sequence of a M2-1 protein encoded by the viral genome of SEQ ID NO:18, SEQ ID NO:19, SEQ ID NO:20, or SEQ ID NO:21 (the amino acid sequences of the respective M2-1 proteins are disclosed in SEQ ID NO:338-341; see also Table 14). In certain embodiments of the invention, the protein of a mammalian MPV is a M2-2 protein, wherein the M2-2 protein is at least 60%, at least 65%, at least 70%, at least 75%, at least 80%, at least 85%, at least 90%, at least 95%, at least 98%, at least 99%, or at least 99.5% identical to the amino acid sequence of a M2-2 protein encoded by the viral genome of SEQ ID NO:18, SEQ ID NO:19, SEQ ID NO:20, or SEQ ID NO:21 (the amino acid sequences of the respective M2-2 proteins are disclosed in SEQ ID NO:346-349; see also Table 14). In certain embodiments of the invention, the protein of a mammalian MPV is a G protein, wherein the G protein is at least 60%, at least 65%, at least 70%, at least 75%, at least 80%, at least 85%, at least 90%, at least 95%, at least 98%, at least 99%, or at least 99.5% identical to the amino acid sequence of a G protein encoded by the viral genome of SEQ ID NO:18, SEQ ID NO:19, SEQ ID NO:20, or SEQ ID NO:21 (the amino acid sequences of the respective G proteins are disclosed in SEQ ID NO:322-325; see also Table 14). In certain embodiments of the invention, the protein of a mammalian MPV is a SH protein, wherein the SH protein is at least 60%, at least 65%, at least 70%, at least 75%, at least 80%, at least 85%, at least 90%, at least 95%, at least 98%, at least 99%, or at least 99.5% identical to the amino acid sequence of a SH protein encoded by the viral genome of SEQ ID NO:18, SEQ ID NO:19, SEQ ID NO:20, or SEQ ID NO:21 (the amino acid sequences of the respective SH proteins are disclosed in SEQ ID NO:382-385; see also Table 14). In certain embodiments of the invention, the protein of a mammalian MPV is a L protein, wherein the L protein is at least 60%, at least 65%, at least 70%, at least 75%, at least 80%, at least 85%, at least 90%, at least 95%, at least 98%, at least 99%, or at least 99.5% identical to the amino acid sequence of a L protein encoded by the viral genome of SEQ ID NO:18, SEQ ID NO:19, SEQ ID NO:20, or SEQ ID NO:21 (the amino acid sequences of the respective L proteins are disclosed in SEQ ID NO:330-333; see also Table 14).

A fragment of a protein of mammalian MPV is at least 60%, at least 65%, at least 70%, at least 75%, at least 80%, at least 85%, at least 90%, at least 95%, at least 98%, at least 99%, or at least 99.5% identical to the homologous protein encoded by the virus of SEQ ID NO:18, SEQ ID NO:19, SEQ ID NO:20, or SEQ ID NO:21 over the portion of the protein that is homologous to the fragment. In a specific, illustrative embodiment, the invention provides a fragment of the F protein of a mammalian MPV that contains the ectodomain of the F protein and homologs thereof. The homolog of the fragment of the F protein that contains the ectodomain is at least 60%, at least 65%, at least 70%, at least 75%, at least 80%, at least 85%, at least 90%, at least 95%, at least 98%, at least 99%, or at least 99.5% identical to the corresponding fragment containing the ectodomain of the F protein encoded by a virus of SEQ ID NO:18, SEQ ID NO:19, SEQ ID NO:20, or SEQ ID NO:21 (the amino acid sequences of the respective F proteins are disclosed in SEQ ID NO:314-317; see also Table 14).

In certain embodiments, the invention provides a protein of a mammalian MPV of subgroup A and fragments thereof. The invention provides a N protein of a mammalian MPV of subgroup A, wherein the N protein is phylogenetically closer related to the N protein encoded by a virus of SEQ ID NO:19 or SEQ ID NO:20 than it is related to the N protein encoded by a virus encoded by SEQ ID NO:18 or SEQ ID NO:21. The invention provides a G protein of a mammalian MPV of subgroup A, wherein the G protein is phylogenetically closer related to the G protein encoded by a virus of SEQ ID NO:19 or SEQ ID NO:20 than it is related to the G protein encoded by a virus encoded by SEQ ID NO:18 or SEQ ID NO:21. The invention provides a P protein of a mammalian MPV of subgroup A, wherein the P protein is phylogenetically closer related to the P protein encoded by a virus of SEQ ID NO:19 or SEQ ID NO:20 than it is related to the P protein encoded by a virus encoded by SEQ ID NO:18 or SEQ ID NO:21. The invention provides a M protein of a mammalian MPV of subgroup A, wherein the M protein is phylogenetically closer related to the M protein encoded by a virus of SEQ ID NO:19 or SEQ ID NO:20 than it is related to the M protein encoded by a virus encoded by SEQ ID NO:18 or SEQ ID NO:21. The invention provides a N protein of a mammalian MPV of subgroup A, wherein the F protein is phylogenetically closer related to the F protein encoded by a virus of SEQ ID NO:19 or SEQ ID NO:20 than it is related to the F protein encoded by a virus encoded by SEQ ID NO:18 or SEQ ID NO:21. The invention provides a M2-1 protein of a mammalian MPV of subgroup A, wherein the M2-1 protein is phylogenetically closer related to the M2-1 protein encoded by a virus of SEQ ID NO:19 or SEQ ID NO:20 than it is related to the M2-1 protein encoded by a virus encoded by SEQ ID NO:18 or SEQ ID NO:21. The invention provides a M2-2 protein of a mammalian MPV of subgroup A, wherein the M2-2 protein is phylogenetically closer related to the M2-2 protein encoded by a virus of SEQ ID NO:19 or SEQ ID NO:20 than it is related to the M2-2 protein encoded by a virus encoded by SEQ ID NO:18 or SEQ ID NO:21. The invention provides a SH protein of a mammalian MPV of subgroup A, wherein the SH protein is phylogenetically closer related to the SH protein encoded by a virus of SEQ ID NO:19 or SEQ ID NO:20 than it is related to the SH protein encoded by a virus encoded by SEQ ID NO:18 or SEQ ID NO:21. The invention provides a L protein of a mammalian MPV of subgroup A, wherein the L protein is phylogenetically closer related to the L protein encoded by a virus of SEQ ID NO: 9 or SEQ ID NO:20 than it is related to the L protein encoded by a virus encoded by SEQ ID NO:18 or SEQ ID NO:21.

In other embodiments, the invention provides a protein of a mammalian MPV of subgroup B or fragments thereof. The invention provides a N protein of a mammalian MPV of subgroup B, wherein the N protein is phylogenetically closer related to the N protein encoded by a virus of SEQ ID NO:18 or SEQ ID NO:21 than it is related to the N protein encoded by a virus encoded by SEQ ID NO:19 or SEQ ID NO:20. The invention provides a G protein of a mammalian MPV of subgroup A, wherein the G protein is phylogenetically closer related to the G protein encoded by a virus of SEQ ID NO:18 or SEQ ID NO:21 than it is related to the G protein encoded by a virus encoded by SEQ ID NO:19 or SEQ ID NO:20. The invention provides a P protein of a mammalian MPV of subgroup A, wherein the P protein is phylogenetically closer related to the P protein encoded by a virus of SEQ ID NO:18 or SEQ ID NO:21 than it is related to the P protein encoded by a virus encoded by SEQ ID NO:19 or SEQ ID NO:20. The invention provides a M protein of a mammalian MPV of subgroup A, wherein the M protein is phylogenetically closer related to the M protein encoded by a virus of SEQ ID NO:18 or SEQ ID NO:21 than it is related to the M protein encoded by a virus encoded by SEQ ID NO:19 or SEQ ID NO:20. The invention provides a N protein of a mammalian MPV of subgroup A, wherein the F protein is phylogenetically closer related to the F protein encoded by a virus of SEQ ID NO:18 or SEQ ID NO:21 than it is related to the F protein encoded by a virus encoded by SEQ ID NO:19 or SEQ ID NO:20. The invention provides a M2-1 protein of a mammalian MPV of subgroup A, wherein the M2-1 protein is phylogenetically closer related to the M2-1 protein encoded by a virus of SEQ ID NO:18 or SEQ ID NO:21 than it is related to the M2-1 protein encoded by a virus encoded by SEQ ID NO:19 or SEQ ID NO:20. The invention provides a M2-2 protein of a mammalian MPV of subgroup A, wherein the M2-2 protein is phylogenetically closer related to the M2-2 protein encoded by a virus of SEQ ID NO:18 or SEQ ID NO:21 than it is related to the M2-2 protein encoded by a virus encoded by SEQ ID NO:19 or SEQ ID NO:20. The invention provides a SH protein of a mammalian MPV of subgroup A, wherein the SH protein is phylogenetically closer related to the SH protein encoded by a virus of SEQ ID NO:18 or SEQ ID NO:21 than it is related to the SH protein encoded by a virus encoded by SEQ ID NO:19 or SEQ ID NO:20. The invention provides a L protein of a mammalian MPV of subgroup A, wherein the L protein is phylogenetically closer related to the L protein encoded by a virus of SEQ ID NO:18 or SEQ ID NO:21 than it is related to the L protein encoded by a virus encoded by SEQ ID NO:19 or SEQ ID NO:20.

The invention further provides proteins of a mammalian MPV of variant A1, A2, B1 or B2. In certain embodiments of the invention, the proteins of the different variants of mammalian MPV can be distinguished from each other by way of their amino acid sequence identities (see, e.g., FIG. 42b). A variant of mammalian MPV can be, but is not limited to, A1, A2, B1 or B2. The invention, however, also contemplates isolates of mammalian MPV that are members of another variant.

The invention provides a G protein of a mammalian MPV variant B1, wherein the G protein of a mammalian MPV variant B1 is phylogenetically closer related to the G protein of the prototype of variant B1, isolate NL/1/99, than it is related to the G protein of the prototype of variant A1, isolate NL/1/00, the G protein of the prototype of A2, isolate NL/17/00, or the G protein of the prototype of B2, isolate NL/1/94. The invention provides a G protein of a mammalian MPV variant B1, wherein the amino acid sequence of the G protein is at least 66%, at least 70%, at least 75%, at least 80%, at least 85%, at least 90%, at least 95%, at least 98%, or at least 99% or at least 99.5% identical to the G protein of a mammalian MPV variant B1 as represented by the prototype NL/1/99 (SEQ ID NO:324). The invention provides a N protein of a mammalian MPV variant B1, wherein the N protein of a mammalian MPV variant B1 is phylogenetically closer related to the N protein of the prototype of variant B1, isolate NL/1/99, than it is related to the N protein of the prototype of variant A1, isolate NL/1/00, the N protein of the prototype of A2, isolate NL/17/00, or the N protein of the prototype of B2, isolate NL/1/94. The invention provides a N protein of a mammalian MPV variant B1, wherein the amino acid sequence of the N proteint is at least 98.5% or at least 99% or at least 99.5% identical to the N protein of a mammalian MPV variant B1 as represented by the prototype NL/1/99 (SEQ ID NO:368). The invention provides a P protein of a mammalian MPV variant B1, wherein the P protein of a mammalian MPV variant B1 is phylogenetically closer related to the P protein of the prototype of variant B1, isolate NL/1/99, than it is related to the P protein of the prototype of variant A1, isolate NL/1/00, the P protein of the prototype of A2, isolate NL/17/00, or the P protein of the prototype of B2, isolate NL/1/94. The invention provides a P protein of a mammalian MPV variant B1, wherein the amino acid sequence of the P protein is at least 96%, at least 98%, or at least 99% or at least 99.5% identical the P protein of a mammalian MPV variant B1 as represented by the prototype NL/1/99 (SEQ ID NO:376). The invention provides a M protein of a mammalian MPV variant B1, wherein the M protein of a mammalian MPV variant B1 is phylogenetically closer related to the M protein of the prototype of variant B1, isolate NL/1/99, than it is related to the M protein of the prototype of variant A1, isolate NL/1/00, the M protein of the prototype of A2, isolate NL/17/00, or the M protein of the prototype of B2, isolate NL/1/94. The invention provides a M protein of a mammalian MPV variant B1, wherein the amino acid sequence of the M protein is identical the M protein of a mammalian MPV variant B1 as represented by the prototype NL/1/99 (SEQ ID NO:360). The invention provides a F protein of a mammalian MPV variant B1, wherein the F protein of a mammalian MPV variant B1 is phylogenetically closer related to the F protein of the prototype of variant B1, isolate NL/1/99, than it is related to the F protein of the prototype of variant A1, isolate NL/1/00, the F protein of the prototype of A2, isolate NL/17/00, or the F protein of the prototype of B2, isolate NL/1/94. The invention provides a F protein of a mammalian MPV variant B1, wherein the amino acid sequence of the F protein is at least 99% identical to the F protein of a mammalian MPV variant B1 as represented by the prototype NL/1/99 (SEQ ID NO:316). The invention provides a M2-1 protein of a mammalian MPV variant B1, wherein the M2-1 protein of a mammalian MPV variant B1 is phylogenetically closer related to the M2-1 protein of the prototype of variant B1, isolate NL/1/99, than it is related to the M2-1 protein of the prototype of variant A1, isolate NL/1/00, the M2-1 protein of the prototype of A2, isolate NL/17/00, or the M2-1 protein of the prototype of B2, isolate NL/1/94. The invention provides a M2-1 protein of a mammalian MPV variant B1, wherein the amino acid sequence of the M2-1 protein is at least 98% or at least 99% or at least 99.5% identical the M2-1 protein of a mammalian MPV variant B1 as represented by the prototype NL/1/99 (SEQ ID NO:340). The invention provides a M2-2 protein of a mammalian MPV variant B1, wherein the M2-2 protein of a mammalian MPV variant B1 is phylogenetically closer related to the M2-2 protein of the prototype of variant B1, isolate NL/1/99, than it is related to the M2-2 protein of the prototype of variant A1, isolate NL/1/00, the M2-2 protein of the prototype of A2, isolate NL/17/00, or the M2-2 protein of the prototype of B2, isolate NL/1/94. The invention provides a M2-2 protein of a mammalian MPV variant B1, wherein the amino acid sequence of the M2-2 protein is at least 99% or at least 99.5% identical the M2-2 protein of a mammalian MPV variant B1 as represented by the prototype NL/1/99 (SEQ ID NO:348). The invention provides a SH protein of a mammalian MPV variant B1, wherein the SH protein of a mammalian MPV variant B1 is phylogenetically closer related to the SH protein of the prototype of variant B1, isolate NL/1/99, than it is related to the SH protein of the prototype of variant A1, isolate NL/1/00, the SH protein of the prototype of A2, isolate NL/17/00, or the SH protein of the prototype of B2, isolate NL/1/94. The invention provides a SH protein of a mammalian MPV variant B1, wherein the amino acid sequence of the SH protein is at least 83%, at least 85%, at least 90%, at least 95%, at least 98%, or at least 99% or at least 99.5% identical the SH protein of a mammalian MPV variant B1 as represented by the prototype NL/1/99 (SEQ ID NO:384). The invention provides a L protein of a mammalian MPV variant B1, wherein the L protein of a mammalian MPV variant B1 is phylogenetically closer related to the L protein of the prototype of variant B1, isolate NL/1/99, than it is related to the L protein of the prototype of variant A1, isolate NL/1/00, the L protein of the prototype of A2, isolate NL/17/00, or the L protein of the prototype of B2, isolate NL/1/94. The invention provides a L protein of a mammalian MPV variant B1, wherein the amino acid sequence of the L protein is at least 99% or at least 99.5% identical the L protein a mammalian MPV variant B1 as represented by the prototype NL/1/99 (SEQ ID NO:332).

The invention provides a G protein of a mammalian MPV variant A1, wherein the G protein of a mammalian MPV variant A1 is phylogenetically closer related to the G protein of the prototype of variant A1, isolate NL/1/00, than it is related to the G protein of the prototype of variant B1, isolate NL/1/99, the G protein of the prototype of A2, isolate NL/17/00, or the G protein of the prototype of B2, isolate NL/1/94. The invention provides a G protein of a mammalian MPV variant A1, wherein the amino acid sequence of the G protein is at least 66%, at least 70%, at least 75%, at least 80%, at least 85%, at least 90%, at least 95%, at least 98%, or at least 99% or at least 99.5% identical to the G protein of a mammalian MPV variant A1 as represented by the prototype NL/1/00 (SEQ ID NO:322). The invention provides a N protein of a mammalian MPV variant A1, wherein the N protein of a mammalian MPV variant A1 is phylogenetically closer related to the N protein of the prototype of variant A1, isolate NL/1/00, than it is related to the N protein of the prototype of variant B1, isolate NL/1/99, the N protein of the prototype of A2, isolate NL/17/00, or the N protein of the prototype of B2, isolate NL/1/94. The invention provides a N protein of a mammalian MPV variant A1, wherein the amino acid sequence of the N protein is at least 99.5% identical to the N protein of a mammalian MPV variant A1 as represented by the prototype NL/1/00 (SEQ ID NO:366). The invention provides a P protein of a mammalian MPV variant A1, wherein the P protein of a mammalian MPV variant A1 is phylogenetically closer related to the P protein of the prototype of variant A1, isolate NL/1/00, than it is related to the P protein of the prototype of variant B1, isolate NL/1/99, the P protein of the prototype of A2, isolate NL/17/00, or the P protein of the prototype of B2, isolate NL/1/94. The invention provides a P protein of a mammalian MPV variant A1, wherein the amino acid sequence of the P protein is at least 96%, at least 98%, or at least 99% or at least 99.5% identical to the P protein of a mammalian MPV variant A1 as represented by the prototype NL/1/00 (SEQ ID NO:374). The invention provides a M protein of a mammalian MPV variant A1, wherein the M protein of a mammalian MPV variant A1 is phylogenetically closer related to the M protein of the prototype of variant A1, isolate NL/1/00, than it is related to the M protein of the prototype of variant B1, isolate NL/1/99, the M protein of the prototype of A2, isolate NL/17/00, or the M protein of the prototype of B2, isolate NL/1/94. The invention provides a M protein of a mammalian MPV variant A1, wherein the amino acid sequence of the M protein is at least 99% or at least 99.5% identical to the M protein of a mammalian MPV variant A1 as represented by the prototype NL/1/00 (SEQ ID NO:358). The invention provides a F protein of a mammalian MPV variant A1, wherein the F protein of a mammalian MPV variant A1 is phylogenetically closer related to the F protein of the prototype of variant A1, isolate NL/1/00, than it is related to the F protein of the prototype of variant B1, isolate NL/1/99, the F protein of the prototype of A2, isolate NL/17/00, or the F protein of the prototype of B2, isolate NL/1/94. The invention provides a F protein of a mammalian MPV variant A1, wherein the amino acid sequence of the F protein is at least 98% or at least 99% or at least 99.5% identical to the F protein of a mammalian MPV variant A1 as represented by the prototype NL/1/00 (SEQ ID NO:314). The invention provides a M2-1 protein of a mammalian MPV variant A1, wherein the M2-1 protein of a mammalian MPV variant A1 is phylogenetically closer related to the M2-1 protein of the prototype of variant A1, isolate NL/1/00, than it is related to the M2-1 protein of the prototype of variant B1, isolate NL/1/99, the M2-1 protein of the prototype of A2, isolate NL/17/00, or the M2-1 protein of the prototype of B2, isolate NL/1/94. The invention provides a M2-1 protein of a mammalian MPV variant A1, wherein the amino acid sequence of the M2-1 protein is at least 99% or at least 99.5% identical to the M2-1 protein of a mammalian MPV variant A1 as represented by the prototype NL/1/00 (SEQ ID NO:338). The invention provides a M2-2 protein of a mammalian MPV variant A1, wherein the M2-2 protein of a mammalian MPV variant A1 is phylogenetically closer related to the M2-2 protein of the prototype of variant A1, isolate NL/1/00, than it is related to the M2-2 protein of the prototype of variant B1, isolate NL/1/99, the M2-2 protein of the prototype of A2, isolate NL/17/00, or the M2-2 protein of the prototype of B2, isolate NL/1/94. The invention provides a M2-2 protein of a mammalian MPV variant A1, wherein the amino acid sequence of the M2-2 protein is at least 96% or at least 99% or at least 99.5% identical to the M2-2 protein of a mammalian MPV variant A1 as represented by the prototype NL/1/00 (SEQ ID NO:346). The invention provides a SH protein of a mammalian MPV variant A1, wherein the SH protein of a mammalian MPV variant A1 is phylogenetically closer related to the SH protein of the prototype of variant A1, isolate NL/1/00, than it is related to the SH protein of the prototype of variant B1, isolate NL/1/99, the SH protein of the prototype of A2, isolate NL/17/00, or the SH protein of the prototype of B2, isolate NL/1/94. The invention provides a SH protein of a mammalian MPV variant A1, wherein the amino acid sequence of the SH protein is at least 84%, at least 90%, at least 95%, at least 98%, or at least 99% or at least 99.5% identical to the SH protein of a mammalian MPV variant A1 as represented by the prototype NL/1/00 (SEQ ID NO:382). The invention provides a L protein of a mammalian MPV variant A1, wherein the L protein of a mammalian MPV variant A1 is phylogenetically closer related to the L protein of the prototype of variant A1, isolate NL/1/00, than it is related to the L protein of the prototype of variant B1, isolate NL/1/99, the L protein of the prototype of A2, isolate NL/17/00, or the L protein of the prototype of B2, isolate NL/1/94. The invention provides a L protein of a mammalian MPV variant A1, wherein the amino acid sequence of the L protein is at least 99% or at least 99.5% identical to the L protein of a virus of a mammalian MPV variant A1 as represented by the prototype NL/1/00 (SEQ ID NO:330).

The invention provides a G protein of a mammalian MPV variant A2, wherein the G protein of a mammalian MPV variant A2 is phylogenetically closer related to the G protein of the prototype of variant A2, isolate NL/17/00, than it is related to the G protein of the prototype of variant B1, isolate NL/1/99, the G protein of the prototype of A1, isolate NL/1/00, or the G protein of the prototype of B2, isolate NL/1/94. The invention provides a G protein of a mammalian MPV variant A2, wherein the amino acid sequence of the G protein is at least 66%, at least 70%, at least 75%, at least 80%, at least 85%, at least 90%, at least 95%, at least 98%, at least 99% or at least 99.5% identical to the G protein of a mammalian MPV variant A2 as represented by the prototype NL/17/00 (SEQ ID NO:332). The invention provides a N protein of a mammalian MPV variant A2, wherein the N protein of a mammalian MPV variant A2 is phylogenetically closer related to the N protein of the prototype of variant A2, isolate NL/17/00, than it is related to the N protein of the prototype of variant B1, isolate NL/1/99, the N protein of the prototype of A1, isolate NL/1/00, or the N protein of the prototype of B2, isolate NL/1/94. The invention provides a N protein of a mammalian MPV variant A2, wherein the amino acid sequence of the N protein at least 99.5% identical to the N protein of a mammalian MPV variant A2 as represented by the prototype NL/17/00 (SEQ ID NO:367). The invention provides a P protein of a mammalian MPV variant A2, wherein the P protein of a mammalian MPV variant A2 is phylogenetically closer related to the P protein of the prototype of variant A2, isolate NL/17/00, than it is related to the P protein of the prototype of variant B1, isolate NL/1/99, the P protein of the prototype of A1, isolate NL/1/00, or the P protein of the prototype of B2, isolate NL/1/94. The invention provides a P protein of a mammalian MPV variant A2, wherein the amino acid sequence of the P protein is at least 96%, at least 98%, at least 99% or at least 99.5% identical to the P protein of a mammalian MPV variant A2 as represented by the prototype NL/17/00(SEQ ID NO:375). The invention provides a M protein of a mammalian MPV variant A2, wherein the M protein of a mammalian MPV variant A2 is phylogenetically closer related to the M protein of the prototype of variant A2, isolate NL/17/00, than it is related to the M protein of the prototype of variant B1, isolate NL/1/99, the M protein of the prototype of A1, isolate NL/1/00, or the M protein of the prototype of B2, isolate NL/1/94. The invention provides a M protein of a mammalian MPV variant A2, wherein the the amino acid sequence of the M protein is at least 99%, or at least 99.5% identical to the M protein of a mammalian MPV variant A2 as represented by the prototype NL/17/00(SEQ ID NO:359). The invention provides a F protein of a mammalian MPV variant A2, wherein the F protein of a mammalian MPV variant A2 is phylogenetically closer related to the F protein of the prototype of variant A2, isolate NL/17/00, than it is related to the F protein of the prototype of variant B1, isolate NL/1/99, the F protein of the prototype of A1, isolate NL/1/00, or the F protein of the prototype of B2, isolate NL/1/94. The invention provides a F protein of a mammalian MPV variant A2, wherein the amino acid sequence of the F protein is at least 98%, at least 99% or at least 99.5% identical to the F protein of a mammalian MPV variant A2 as represented by the prototype NL/17/00 (SEQ ID NO:315). The invention provides a M2-1 protein of a mammalian MPV variant A2, wherein the M2-1 protein of a mammalian MPV variant A2 is phylogenetically closer related to the M2-1 protein of the prototype of variant A2, isolate NL/17/00, than it is related to the M2-1 protein of the prototype of variant B1, isolate NL/1/99, the M2-1 protein of the prototype of A1, isolate NL/1/00, or the M2-1 protein of the prototype of B2, isolate NL/1/94. The invention provides a M2-1 protein of a mammalian MPV variant A2, wherein the amino acid sequence of the M2-1 protein is at least 99%, or at least 99.5% identical to the M2-1 protein of a mammalian MPV variant A2 as represented by the prototype NL/17/00 (SEQ ID NO: 339). The invention provides a M2-2 protein of a mammalian MPV variant A2, wherein the M2-2 protein of a mammalian MPV variant A2 is phylogenetically closer related to the M2-2 protein of the prototype of variant A2, isolate NL/17/00, than it is related to the M2-2 protein of the prototype of variant B1, isolate NL/1/99, the M2-2 protein of the prototype of A1, isolate NL/1/00, or the M2-2 protein of the prototype of B2, isolate NL/1/94. The invention provides a M2-2 protein of a mammalian MPV variant A2, wherein the amino acid sequence of the M2-2 protein is at least 96%, at least 98%, at least 99% or at least 99.5% identical to the M2-2 protein of a mammalian MPV variant A2 as represented by the prototype NL/17/00 (SEQ ID NO:347). The invention provides a SH protein of a mammalian MPV variant A2, wherein the SH protein of a mammalian MPV variant A2 is phylogenetically closer related to the SH protein of the prototype of variant A2, isolate NL/17/00, than it is related to the SH protein of the prototype of variant B1, isolate NL/1/99, the SH protein of the prototype of A1, isolate NL/1/00, or the SH protein of the prototype of B2, isolate NL/1/94. The invention provides a SH protein of a mammalian MPV variant A2, wherein the amino acid sequence of the SH protein is at least 84%, at least 85%, at least 90%, at least 95%, at least 98%, at least 99% or at least 99.5% identical to the SH protein of a mammalian MPV variant A2 as represented by the prototype NL/17/00 (SEQ ID NO:383). The invention provides a L protein of a mammalian MPV variant A2, wherein the L protein of a mammalian MPV variant A2 is phylogenetically closer related to the L protein of the prototype of variant A2, isolate NL/17/00, than it is related to the L protein of the prototype of variant B1, isolate NL/1/99, the L protein of the prototype of A1, isolate NL/1/00, or the L protein of the prototype of B2, isolate NL/1/94. The invention provides a L protein of a mammalian MPV variant A2, wherein the amino acid sequence of the L protein is at least 99% or at least 99.5% identical to the L protein of a mammalian MPV variant A2 as represented by the prototype NL/17/00 (SEQ ID NO:331).

The invention provides a G protein of a mammalian MPV variant B2, wherein the G protein of a mammalian MPV variant B2 is phylogenetically closer related to the G protein of the prototype of variant B2, isolate NL/1/94, than it is related to the G protein of the prototype of variant B1, isolate NL/1/99, the G protein of the prototype of A1, isolate NL/1/00, or the G protein of the prototype of A2, isolate NL/17/00. The invention provides a G protein of a mammalian MPV variant B2, wherein the amino acid sequence of the G protein is at least 66%, at least 70%, at least 75%, at least 80%, at least 85%, at least 90%, at least 95%, at least 98%, or at least 99% or at least 99.5% identical to the G protein of a mammalian MPV variant B2 as represented by the prototype NL/1/94 (SEQ ID NO:325). The invention provides a N protein of a mammalian MPV variant B2, wherein the N protein of a mammalian MPV variant B2 is phylogenetically closer related to the N protein of the prototype of variant B2, isolate NL/1/94, than it is related to the N protein of the prototype of variant B1, isolate NL/1/99, the N protein of the prototype of A1, isolate NL/1/00, or the N protein of the prototype of A2, isolate NL/17/00. The invention provides a N protein of a mammalian MPV variant B2, wherein the amino acid sequence of the N protein is at least 99% or at least 99.5% identical to the N protein of a mammalian MPV variant B2 as represented by the prototype NL/1/94 (SEQ ID NO:369). The invention provides a P protein of a mammalian MPV variant B2, wherein the P protein of a mammalian MPV variant B2 is phylogenetically closer related to the P protein of the prototype of variant B2, isolate NL/1/94, than it is related to the P protein of the prototype of variant B1, isolate NL/1/99, the P protein of the prototype of A1, isolate NL/1/00, or the P protein of the prototype of A2, isolate NL/17/00. The invention provides a P protein of a mammalian MPV variant B2, wherein the amino acid sequence of the P protein is at least 96%, at least 98%, or at least 99% or at least 99.5% identical to the P protein of a mammalian MPV variant B2 as represented by the prototype NL/1/94 (SEQ ID NO:377). The invention provides a M protein of a mammalian MPV variant B2, wherein the M protein of a mammalian MPV variant B2 is phylogenetically closer related to the M protein of the prototype of variant B2, isolate NL/1/94, than it is related to the M protein of the prototype of variant B1, isolate NL/1/99, the M protein of the prototype of A1, isolate NL/1/00, or the M protein of the prototype of A2, isolate NL/17/00. The invention provides a M protein of a mammalian MPV variant B2, wherein the amino acid sequence of its M protein is identical to the M protein of a mammalian MPV variant B2 as represented by the prototype NL/1/94 (SEQ ID NO:361). The invention provides a F protein of a mammalian MPV variant B2, wherein the F protein of a mammalian MPV variant B2 is phylogenetically closer related to the F protein of the prototype of variant B2, isolate NL/1/94, than it is related to the F protein of the prototype of variant B1, isolate NL/1/99, the F protein of the prototype of A1, isolate NL/1/00, or the F protein of the prototype of A2, isolate NL/17/00. The invention provides a F protein of a mammalian MPV variant B2, wherein the amino acid sequence of the F protein is at least 99% or at least 99.5% identical to the F protein of a mammalian MPV variant B2 as represented by the prototype NL/1/94 (SEQ ID NO:317). The invention provides a M2-1 protein of a mammalian MPV variant B2, wherein the M2-1 protein of a mammalian MPV variant B2 is phylogenetically closer related to the M2-1 protein of the prototype of variant B2, isolate NL/1/94, than it is related to the M2-1 protein of the prototype of variant B1, isolate NL/1/99, the M2-1 protein of the prototype of A1, isolate NL/1/00, or the M2-1 protein of the prototype of A2, isolate NL/17/00. The invention provides a M2-1 protein of a mammalian MPV variant B2, wherein the amino acid sequence of the M2-1 protein is at least 98% or at least 99% or at least 99.5% identical to the M2-1 protein of a mammalian MPV variant B2 as represented by the prototype NL/1/94 (SEQ ID NO:341). The invention provides a M2-2 protein of a mammalian MPV variant B2, wherein the M2-2 protein of a mammalian MPV variant B2 is phylogenetically closer related to the M2-2 protein of the prototype of variant B2, isolate NL/1/94, than it is related to the M2-2 protein of the prototype of variant B1, isolate NL/1/99, the M2-2 protein of the prototype of A1, isolate NL/1/00, or the M2-2 protein of the prototype of A2, isolate NL/17/00. The invention provides a M2-2 protein of a mammalian MPV variant B2, wherein the amino acid sequence is at least 99% or at least 99.5% identical to the M2-2 protein of a mammalian MPV variant B2 as represented by the prototype NL/1/94 (SEQ ID NO:350). The invention provides a SH protein of a mammalian MPV variant B2, wherein the SH protein of a mammalian MPV variant B2 is phylogenetically closer related to the SH protein of the prototype of variant B2, isolate NL/1/94, than it is related to the SH protein of the prototype of variant B1, isolate NL/1/99, the SH protein of the prototype of A1, isolate NL/1/00, or the SH protein of the prototype of A2, isolate NL/17/00. The invention provides a SH protein of a mammalian MPV variant B2, wherein the amino acid sequence of the SH protein is at least 84%, at least 85%, at least 90%, at least 95%, at least 98%, or at least 99% or at least 99.5% identical to the SH protein of a mammalian MPV variant B2 as represented by the prototype NL/1/94 (SEQ ID NO:385). The invention provides a L protein of a mammalian MPV variant B2, wherein the L protein of a mammalian MPV variant B2 is phylogenetically closer related to the L protein of the prototype of variant B2, isolate NL/1/94, than it is related to the L protein of the prototype of variant B1, isolate NL/1/99, the L protein of the prototype of A1, isolate NL/1/00, or the L protein of the prototype of A2, isolate NL/17/00. The invention provides a L protein of a mammalian MPV variant B2, wherein the and/or if the amino acid sequence of the L protein is at least 99% or at least 99.5% identical to the L protein of a mammalian MPV variant B2 as represented by the prototype NL/1/94 (SEQ ID NO:333).

In certain embodiments, the percentage of sequence identity is based on an alignment of the full length proteins. In other embodiments, the percentage of sequence identity is based on an alignment of contiguous amino acid sequences of the proteins, wherein the amino acid sequences can be 25 amino acids, 50 amino acids, 75 amino acids, 100 amino acids, 125 amino acids, 150 amino acids, 175 amino acids, 200 amino acids, 225 amino acids, 250 amino acids, 275 amino acids, 300 amino acids, 325 amino acids, 350 amino acids, 375 amino acids, 400 amino acids, 425 amino acids, 450 amino acids, 475 amino acids, 500 amino acids, 750 amino acids, 1000 amino acids, 1250 amino acids, 1500 amino acids, 1750 amino acids, 2000 amino acids or 2250 amino acids in length.

In certain, specific embodiments, the invention provides a G protein of a mammalian MPV wherein the G protein has one of the amino acid sequences set forth in SEQ ID NO:119-153; SEQ ID NO:322-325 or a fragment thereof. In certain, specific embodiments, the invention provides a F protein of a mammalian MPV wherein the F protein has one of the amino acid sequences set forth in SEQ ID NO:234-317. In certain, specific embodiments, the invention provides a L protein of a mammalian MPV wherein the L protein has one of the amino acid sequences set forth in SEQ IDNO:330-333 or a fragment thereof. In certain, specific embodiments, the invention provides a M2-1 protein of a mammalian MPV wherein the M2-1 protein has one of the amino acid sequences set forth in SEQ ID NO:338-341 or a fragment thereof In certain, specific embodiments, the invention provides a M2-2 protein of a mammalian MPV wherein the M2-2 protein has one of the amino acid sequences set forth in SEQ ID NO:346-349 or a fragment thereof. In certain, specific embodiments, the invention provides a M protein of a mammalian MPV wherein the M protein has one of the amino acid sequences set forth in SEQ ID NO:358-361 or a fragment thereof. In certain, specific embodiments, the invention provides a N protein of a mammalian MPV wherein the N protein has one of the amino acid sequences set forth in SEQ ID NO:366-369 or a fragment thereof. In certain, specific embodiments, the invention provides a P protein of a mammalian MPV wherein the P protein has one of the amino acid sequences set forth in SEQ ID NO:374-377 or a fragment thereof. In certain, specific embodiments, the invention provides a SH protein of a mammalian MPV wherein the SH protein has one of the amino acid sequences set forth in SEQ ID NO:382-385 or a fragment thereof.

In certain embodiments of the invention, a fragment is at least 25 amino acids, 50 amino acids, 75 amino acids, 100 amino acids, 125 amino acids, 150 amino acids, 175 amino acids, 200 amino acids, 225 amino acids, 250 amino acids, 275 amino acids, 300 amino acids, 325 amino acids, 350 amino acids, 375 amino acids, 400 amino acids, 425 amino acids, 450 amino acids, 475 amino acids, 500 amino acids, 750 amino acids, 1000 amino acids, 1250 amino acids, 1500 amino acids, 1750 amino acids, 2000 amino acids or 2250 amino acids in length. In certain embodiments of the invention, a fragment is at most 25 amino acids, 50 amino acids, 75 amino acids, 100 amino acids, 125 amino acids, 150 amino acids, 175 amino acids, 200 amino acids, 225 amino acids, 250 amino acids, 275 amino acids, 300 amino acids, 325 amino acids, 350 amino acids, 375 amino acids, 400 amino acids, 425 amino acids, 450 amino acids, 475 amino acids, 500 amino acids, 750 amino acids, 1000 amino acids, 1250 amino acids, 1500 amino acids, 1750 amino acids, 2000 amino acids or 2250 amino acids in length.

The invention further provides nucleic acid sequences derived from a mammalian MPV. The invention also provides derivatives of nucleic acid sequences derived from a mammalian MPV. In certain specific embodiments the nucleic acids are modified.

In certain embodiments, a nucleic acid of the invention encodes a G protein, a N protein, a P protein, a M protein, a F protein, a M2-1 protein, a M2-2 protein, a SH protein, or a L protein of a mammalian MPV as defined above. In certain embodiments, a nucleic acid of the invention encodes a G protein, a N protein, a P protein, a M protein, a F protein, a M2-1 protein, a M2-2 protein, a SH protein, or a L protein of subgroup A of a mammalian MPV as defined above. In certain embodiments, a nucleic acid of the invention encodes a G protein, a N protein, a P protein, a M protein, a F protein, a M2-1 protein, a M2-2 protein, a SH protein, or a L protein of subgroup B of a mammalian MPV as defined above. In certain embodiments, a nucleic acid of the invention encodes a G protein, a N protein, a P protein, a M protein, a F protein, a M2-1 protein, a M2-2 protein, a SH protein, or a L protein of variant A1 of a mammalian MPV as defined above. In certain embodiments, a nucleic acid of the invention encodes a G protein, a N protein, a P protein, a M protein, a F protein, a M2-1 protein, a M2-2 protein, a SH protein, or a L protein of variant A2 of a mammalian MPV as defined above. In certain embodiments, a nucleic acid of the invention encodes a G protein, a N protein, a P protein, a M protein, a F protein, a M2-1 protein, a M2-2 protein, a SH protein, or a L protein of variant B1 of a mammalian MPV as defined above. In certain embodiments, a nucleic acid of the invention encodes a G protein, a N protein, a P protein, a M protein, a F protein, a M2-1 protein, a M2-2 protein, a SH protein, or a L protein of variant B2 of a mammalian MPV as defined above.

In certain embodiments, the invention provides a nucleotide sequence that is at least 50%, at least 55%, at least 60%, at least 65%, at least 70%, at least 75%, at least 75%, at least 80%, at least 85%, at least 90%, at least 95%, at least 98%, at least 99%, or at least 99.5% identical to the nucleotide sequence of SEQ ID NO:18, SEQ ID NO:19, SEQ ID NO:20, or SEQ ID NO:21. In certain embodiments, the nucleic acid sequence of the invention, is at least 50%, at least 55%, at least 60%, at least 65%, at least 70%, at least 75%, at least 75%, at least 80%, at least 85%, at least 90%, at least 95%, at least 98%, at least 99%, or at least 99.5% identical to a fragment of the nucleotide sequence of SEQ ID NO:18, SEQ ID NO:19, SEQ ID NO:20, or SEQ ID NO:21, wherein the fragment is at least 25 nucleotides, at least 50 nucleotides, at least 75 nucleotides, at least 100 nucleotides, at least 150 nucleotides, at least 200 nucleotides, at least 250 nucleotides, at least 300 nucleotides, at least 400 nucleotides, at least 500 nucleotides, at least 750 nucleotides, at least 1,000 nucleotides, at least 1,250 nucleotides, at least 1,500 nucleotides, at least 1,750 nucleotides, at least 2,000 nucleotides, at least 2,00 nucleotides, at least 3,000 nucleotides, at least 4,000 nucleotides, at least 5,000 nucleotides, at least 7,500 nucleotides, at least 10,000 nucleotides, at least 12,500 nucleotides, or at least 15,000 nucleotides in length. In a specific embodiment, the nucleic acid sequence of the invention is at least 50%, at least 55%, at least 60%, at least 65%, at least 70%, at least 75%, at least 75%, at least 80%, at least 85%, at least 90%, at least 95%, at least 98%, at least 99%, or at least 99.5% or 100% identical to one of the nucleotide sequences of SEQ ID NO:84-118; SEQ ID NO:154-233; SEQ ID NO:318-321; SEQ ID NO:326-329; SEQ ID NO:334-337; SEQ ID NO:342-345; SEQ ID NO:350-353; SEQ ID NO:354-357; SEQ ID NO:362-365; SEQ ID NO:370-373; SEQ ID NO:378-381; or SEQ ID NO:386-389.

In specific embodiments of the invention, a nucleic acid sequence of the invention is capable of hybridizing under low stringency, medium stringency or high stringency conditions to one of the nucleic acid sequences of SEQ ID NO:18, SEQ ID NO:19, SEQ ID NO:20, or SEQ ID NO:21. In specific embodiments of the invention, a nucleic acid sequence of the invention is capable of hybridizing under low stringency, medium stringency or high stringency conditions to one of the nucleic acid sequences of SEQ ID NO:84-118; SEQ ID NO:154-233; SEQ ID NO:318-321; SEQ ID NO:326-329; SEQ ID NO:334-337; SEQ ID NO:342-345; SEQ ID NO:350-353; SEQ ID NO:354-357; SEQ ID NO:362-365; SEQ ID NO:370-373; SEQ ID NO:378-381; or SEQ ID NO:386-389. In certain embodiments, a nucleic acid hybridizes over a length of at least 25 nucleotides, at least 50 nucleotides, at least 75 nucleotides, at least 100 nucleotides, at least 150 nucleotides, at least 200 nucleotides, at least 250 nucleotides, at least 300 nucleotides, at least 400 nucleotides, at least 500 nucleotides, at least 750 nucleotides, at least 1,000 nucleotides, at least 1,250 nucleotides, at least 1,500 nucleotides, at least 1,750 nucleotides, at least 2,000 nucleotides, at least 2,00 nucleotides, at least 3,000 nucleotides, at least 4,000 nucleotides, at least 5,000 nucleotides, at least 7,500 nucleotides, at least 10,000 nucleotides, at least 12,500 nucleotides, or at least 15,000 nucleotides with the nucleotide sequence of SEQ ID NO:18, SEQ ID NO:19, SEQ ID NO:20, or SEQ ID NO:21.

The invention further provides antibodies and antigen-binding fragments that bind specifically to a protein of a mammalian MPV. An antibody of the invention binds specifically to a G protein, a N protein, a P protein, a M protein, a F protein, a M2-1 protein, a M2-2 protein, a SH protein, or a L protein of a mammalian MPV. In specific embodiments, the antibody is a human antibody or a humanized antibody. In certain embodiments, an antibody of the invention binds specifically to a G protein, a N protein, a P protein, a M protein, a F protein, a M2-1 protein, a M2-2 protein, a SH protein, or a L protein of a virus of subgroup A of a mammalian MPV. In certain other embodiments, an antibody of the invention binds specifically to a G protein, a N protein, a P protein, a M protein, a F protein, a M2-1 protein, a M2-2 protein, a SH protein, or a L protein of a virus of subgroup B of a mammalian MPV. In certain, more specific, embodiments, an antibody of the invention binds specifically to a G protein, a N protein, a P protein, a M protein, a F protein, a M2-1 protein, a M2-2 protein, a SH protein, or a L protein of a virus of variant A1 of a mammalian MPV. In other embodiments, the antibody of the invention binds specifically to a G protein, a N protein, a P protein, a M protein, a F protein, a M2-1 protein, a M2-2 protein, a SH protein, or a L protein of a virus of subgroup A2 of a mammalian MPV. In certain embodiments, an antibody of the invention binds specifically to a G protein, a N protein, a P protein, a M protein, a F protein, a M2-1 protein, a M2-2 protein, a SH protein, or a L protein of a virus of subgroup B1 of a mammalian MPV. In certain other embodiments, an antibody of the invention binds specifically to a G protein, a N protein, a P protein, a M protein, a F protein, a M2-1 protein, a M2-2 protein, a SH protein, or a L protein of a virus of subgroup B2 of a mammalian MPV.

6. Virus Isolation and Characterization 6.1 EXAMPLE 1

Specimen Collection, Virus Isolation, Virus Characterization

Samples of nasopharyngeal aspirates were obtained from hosts to assay for the presence of viruses, and also to characterize those identified. Nasopharyngeal aspirates were collected from children suffering from respiratory tract infection (RTI). In order to determine the identity of the cause of illness, all nasopharyngeal aspirates were tested by direct immmunofluorescence assays (DIF) (See method in Example 9), using fluorescence labeled antibodies against influenza virus types A and B, hRSV, and human parainfluenza virus (hPIV) types 1, 2, and 3. Viruses were also isolated from nasopharyngeal aspirates using rapid shell vial techniques, (Rothbarth et. al., 1999, J of Virol. Methods 78:163-169) on various cell lines, including VERO cells, tertiary cynomolgous monkey kidney (tMK) cells, human endothelial lung (HEL) cells and marbin dock kidney (MDCK) cells. Samples showing cytopathic effects (CPE) after two to three passages, that were negative in DIF assays, were tested by indirect immunofluorescence assays (IFA) (See method in Example 11), using virus specific antibodies against influenza virus types A, B and C, hRSV types A and B, measles virus, mumps virus, human parainfluenza virus (hPIV) types 1 to 4, sendai virus, simian virus type 5, and New-Castle disease virus. Although for many cases the aetiological agent could be identified, some specimens were negative for all of the viruses tested.

These 28 unidentified virus isolates grew slowly in tMK cells, poorly in VERO cells and A549 cells and barely in MDCK or chicken embryonated fibroblast cells. Most of the virus isolates induced CPE on tMK cells, between days ten and fourteen. This was somewhat later than the CPE caused by other viruses such as hRSV or hPIV. The CPE were virtually indistinguishable from that caused by hRSV or hPIV in tMK or other cell cultures, and were characterized by syncytium formation. Some of the effects observed on the cells included rapid internal disruption, followed by detachment of the cells from the monolayer.

The supernatants of infected tMK cells were used for Electron Microscopy (EM) analysis, and they revealed the presence of paramyxovirus-like virus particles ranging from 150 to 600 nanometers in diameter, with short envelope projections ranging from 13 to 17 nanometers. Consistent with the biochemical properties of enveloped viruses such as the Paramyxoviridae family of viruses, standard chloroform or ether treatment (Osterhaus et. al., 1985, Arch. of Virol. 86:239-25) resulted in a greater than $10^4$ TCID$_{50}$ reduction in infectivity of tMK cells. Virus-infected tMK cell culture supernatants did not display heamagglutinating activity with turkey, chicken and guinea pig erythrocytes. During culture, the virus replication appeared to be trypsin dependent. These combined virological data demonstrated that the newly identified virus was a taxonomic member of the Paramyxoviridae family.

RNA from tMK cells infected with 15 of the unidentified virus isolates was extracted for use in reverse transcription and polymerase chain reaction (RT-PCR) analyses, using primer-sets specific for Paramyxovirinae (K. B. Chua et al., 2000, Science 288:1432-1435) such as: hPIV 1-4, sendai virus, simian virus type 5, New-Castle disease virus, hRSV, morbilli, mumps, Nipah, Hendra, Tupaia and Mapuera viruses. RT-PCR assays were performed under conditions of low stringency in order to detect potentially related viruses. RNA isolated from homologous virus stocks was used as a control. Whereas the available controls reacted positive with the respective virus-specific primers, the newly identified virus isolates did not react with any primer set, indicating the virus was not closely related to the viruses tested.

Two of the virus-infected tMK cell culture supernatants were used to inoculate guinea pigs and ferrets intranasally. Sera samples were collected from these animals at day zero, two weeks, and three weeks post inoculation. The animals displayed no clinical symptoms, however, the seroconversion of all of the animals was detected and measured in virus neutralization (VN) (See method in Example 16) assays and indirect IFA against the homologous viruses. The sera did not react in indirect IFA with any of the known paramyxoviruses described above or with pneumovirus of mice (PVM). The so far unidentified virus isolates were screened, using the guinea pig and ferret pre-and post-infection sera. Of these, 28 were clearly positive by indirect IFA, with the post-infection sera suggesting that, the thus far unidentified viral isolates, were closely related or identical.

In order further characterize the virus, the phenotypic effects of virus infection on a cell line was examined. In short, tMK cells were cultured in 24 well plates containing glass slides (Costar, Cambridge, UK), with the medium described below supplemented with 10% fetal bovine serum (BioWhittaker, Vervier, Belgium). Before inoculation, the plates were washed with PBS and supplied with Eagle's MEM with Hanks' salt (ICN, Costa mesa, Calif.), of which 0.5L was supplemented with 0.26 g of $NaHCO_3$, 0.025 M Hepes (Biowhittaker), 2 mM L-glutamine (Biowhittaker), 100 units penicillin, 100 µg streptomycin (Biowhittaker), 0.5 g lactalbumin (Sigma-Aldrich, Zwijndrecht, The Netherlands), 1.0 g D-glucose (Merck, Amsterdam, The Netherlands), 5.0 g peptone (Oxoid, Haarlem, The Netherlands) and 0.02% trypsin (Life Technologies, Bethesda, Md.). The plates were inoculated with the supernatant of the nasopharyngeal aspirate samples (0.2 ml per well in triplicate), followed by centrifuging at 840×g for one hour. After inoculation, the plates were incubated at 37° C. for a maximum of 14 days, and the medium was changed once a week while cultures were checked daily for CPE. After 14 days, the cells were scraped from the second passage and incubated for 14 days. This step was repeated for the third passage. The glass slides were used to demonstrate the presence of the virus by indirect IFA as described below.

CPE were generally observed after the third passage, between days 8 to 14, depending on the isolate. The CPE were virtually indistinguishable from that caused by hRSV or hPIV in tMK or other cell cultures, except that hRSV induces CPE at around day 4. CPE were characterized by syncytia formation, after which the cells showed rapid internal disruption, followed by detachment of the cells from the monolayer. For some isolates, CPE were difficult to observe, and IFA was used to confirm the presence of the virus in these cultures. The observation that the CPE were indistinghuishable from those of other viruses indicated that diagnosis could not be made from a visual examination of clinical symptoms.

6.2 EXAMPLE 2

Seroprevalence in the Human Population

To study the seroprevalence of this virus in the human population, sera from humans in different age categories were analyzed by indirect IFA using tMK cells infected with one of the unidentified virus isolates. Studies revealed that antibodies to the virus could be detected in 25% of the children between six and twelve months. Furthermore, by the age of five, nearly 100% of the children were seropositive. In total, 56 sera samples examined by indirect IFA and by VN assay. For 51 of the samples or 91%, the results of the VN assay, i.e., a titer greater than 8, coincided with the results obtained with indirect IFA, i.e., a titer greater than 32. Four samples that were found to be positive by IFA, were negative by the VN assay, i.e., titer less than 8, whereas one serum sample was negative by IFA, i.e., titer less than 32, and was positive by the VN test, i.e., a titer of 16 (FIG. 2).

IFA conducted on 72 sera samples taken from humans in 1958, with ages ranging from 8-99 years, revealed a 100% seroprevalence rate, indicating the virus has been circulating in the human population for more than 40 years. In addition, a number of these sera samples were used in VN assays to confirm the IFA data (FIG. 2). The seroprevalence data indicate that the virus has been a significant source of infection in the human population for many years.

The repeated isolation of this virus from clinical samples from children with severe RTI indicates that the clinical and economic impact of MPV may be high. New diagnostic assays based on virus detection and serology would yield a more detailed analysis of the incidence rate and also of the clinical and economical impact of this viral pathogen.

The slight differences between the IFA and VN results (5 samples) may have been due to the fact that in the IFA, only IgG serum antibodies were detected, whereas the VN assay detects both classes and sub-classes of antibodies. Alternatively, differences may have been due to the differences in sensitivity between both assays. For IFA, a threshold value of 16 was used, whereas for VN a value of 8 was used.

Differences between results in the IFA and VN assays may also indicate possible differences between serotypes of this newly identified virus. Since MPV seems to be most closely related to APV, it was speculated that the human virus may have originated from birds. Analysis of serum samples taken from humans in 1958 revealed that MPV has been widespread in the human population for more then 40 years, indicating that a tentative zoonosis event must have taken place long before 1958.

6.3 EXAMPLE 3

Genomic Sequence of HMPV Isolate 00-1

In order to obtain sequence information for the unknown virus isolates, a random PCR amplification strategy known as RAP-PCR (Welsh et. al., 1992, NAR 20:4965-4970) (See Example 19). In short, tMK cells were infected with one of the virus isolates (isolate 00-1) as well as with hPIV-1 that served as a positive control. After both cultures displayed similar levels of CPE, virus in the culture supernatants was purified on continuous 20-60% sucrose gradients. The gradient fractions were inspected for virus-like particles by EM, and RNA was isolated from the fraction that contained approximately 50% sucrose, in which nucleocapsids were observed. Equivalent amounts of RNA isolated from both virus fractions were used for RAP-PCR, after which samples were run side by side on a 3% NuSieve agarose gel. Twenty differentially displayed bands specific for the unidentified virus were subsequently purified from the gel, cloned in plasmid pCR2.1 (Invitrogen) and sequenced (See Example 20) with vector-specific primers. A search for homologies against sequences in the Genbank database, using the BLAST program available through the National Library of Medicine, found that 10 out of 20 fragments displayed resemblance to APV/TRTV sequences.

These 10 fragments were located in the genes coding for the nucleoprotein (N; fragment 1 and 2), the matrix protein (M; fragment 3), the fusion protein (F; fragment 4, 5, 6, 7) and the polymerase protein (L; fragment 8, 9, 10) (FIG. 3). PCR primers were designed to complete the sequence information for the 3' end of the viral genome based on our RAP PCR fragments as well as published leader and trailer sequences for the Pneumovirinae (Randhawa, et.al., 1997, J. Virol. 71:9849-9854). Three fragments were amplified, of which fragment A spanned the extreme 3' end of the N open reading frame (ORF), fragment B spanned the phosphoprotein (F) ORF and fragment C closed the gap between the M and F ORFs (FIG. 16). Sequence analyses of these three fragments revealed the absence of NS1 and NS2 ORFs at the extreme 3' end of the viral genome and positioning of the F ORF immediately adjacent to the M ORF. This genomic organization resembled that of the *metapnuemovirus* APV, which was also consistent with the sequence homology. Relation between different viruses could be deduced by comparing the amino acid sequence of FIG. 4 with the amino acid sequence of the respective N proteins of other viruses. Overall the translated sequences for the N, P, M and F ORFs showed an average of 30-33% homology with members of the genus *Pneumovirus* and 66-68% with members of the genus *Metapnuemovirus*. For the SH and G ORFs, no discernable homology was found with members of either genera. The amino acid homologies found for the amino acid sequence of the N ORF showed about 40% homology with hRSV and 88% with APV-C, its closest relative genetically. The amino acid sequence for the P ORF showed about 25% homology with hRSV and about 66-68% with APV-C, the M ORF showed about 36-39% with hRSV and about 87-89% with APV-C, the F ORF showed about 40% homology with hRSV and about 81% with APV-C, the M2-1 ORF showed about 34-36% homology with pneumoviruses and 84-86% with APV-C, the M2-2 ORF showed 15-17% homology with pneumoviruses and 56% with APV-C and the fragments obtained from the L ORF showed an average of 44% with pneumoviruses and 64% with APV-C.

Genetic analyses of the N, M, P and F genes revealed that MPV has higher sequence homology to the recently proposed genus *Metapneumovirinae* as compared to the genus Pneumovirinae and thus demonstrates a genomic organization similar to and resembling that of APV/TRTV. In contrast to the genomic organization of the RSVs ('3-NS1-NS2-N—P-M-SH-G-F-M2-L-5'), metapnuemoviruses lack NS1 and NS2 genes and also have a different genomic organization, specifically between the M and L ('3-N—P-M-F-M2-SH-G-L-5') genes. The lack of ORFs between the M and F genes in the virus isolates of the invention, the lack of NS1 and NS2 adjacent to N, and the high amino acid sequence homology found within APV led to the proposed classification of MPV isolated from humans as the first member of the *Metapnuemovirus* genus of mammals, and more specifically of humans.

Phylogenetic analyses revealed that the nine MPV isolates, from which sequence information was obtained, are closely related. Although sequence information was limited, they appeared to be more closely related to one another than to any of the avian *metapnuemoviruses*. Of the four serotypes of APV that have been described, serotype C appeared to be most closely related to MPV. This conclusion was based upon the nucleotide sequence similarities of the N, P, M and F genes. It should be noted however, that for serotype D, only partial sequences of the F gene were available from Genbank, and for serotype B, only M, N, and F sequences were available. Our MPV isolates formed two clusters in phylogenetic trees. For both hRSV and APV, different genetic and serological subtypes have been described. Whether the two genetic clusters of MPV isolates represent serogical subgroups that are also functionally different remains unknown at present. Our serological surveys showed that MPV is a common human pathogen.

6.4 EXAMPLE 4

Further Characterization of Associated Genes

Sequence analyses of the nucleoprotein (N), phosphoprotein (P), matrixprotein (M) and fusion protein (F) genes of MPV revealed the highest degree of sequence homology with APV serotype C, the avian pneumovirus found primarily in birds in the United States. These analyses also revealed the absence of non-structural proteins NS1 and NS2 at the 3' end of the viral genome and positioning of the fusion protein immediately adjacent to the matrix protein. The sequences of the 22K (M2) gene, the small hydrophobic (SH) gene, the attachment (G) gene, the polymerase (L) gene, the intergenic regions, and the trailer sequences were determined. In combination with the sequences described previously, the sequences presented here completed the genomic sequence of MPV with the exception of the extreme 12-15 nucleotides of the genomic termini and establish the genomic organization of MPV. Side by side comparisons of the sequences of the MPV genome with those of APV subtype A, B and C, RSV subtype A and B, PVM and other paramyxoviruses provides strong evidence for the classification of MPV in the *Metapneumovirus* genus.

GENE ENCODING THE NUCLEOPROTEIN (N): As shown above, the first gene in the genomic map of MPV codes for a 394 amino acid (aa) protein and shows extensive homology with the N protein of other pneumoviruses. The length of the N ORF is identical to the length of the N ORF of APV-C (Table 5) and is smaller than those of other paramyxoviruses (Barr et al., 1991, J Gen Virol 72:677-85). Analysis of the amino acid sequence revealed the highest homology with APV-C (88%), and only 7-11% with other paramyxoviruses (Table 6).

Three regions of similarity between viruses belonging to the order Mononegavirales were identified: A, B and C (FIG. 22) (Barr et al., 1991, J Gen Virol 72: 677-85). Although similarities are highest within a virus family, these regions are highly conserved between virus families observed. In all three regions MPV revealed 97% aa sequence identity with APV-C, 89% with APV-B, 92% with APV-A, and 66-73% with RSV and PYM. The region between aa residues 160 and 340 appears to be highly conserved among *metapnuemoviruses and to a somewhat lesser extent the Pneumovirinae (Miyahara et al.,* 1991, Arch Viral 124:255-68; Li et al., 1996, Virus Res 41:185-91; Barr, 1991, J Gen Virol 72:677-85).

GENE ENCODING THE PHOSPHOPROTEIN (P): The second ORF in the genome map codes for a 294 aa protein which shares 68% aa sequence homology with the P protein of APV-C, and only 22-26% with the P protein of RSV (Table 7). The P gene of MPV contains one substantial ORF and in that respect is similar to P from many other paramyxoviruses (Reviewed in Lamb et. al., Fields virology, (B. N. Knipe, Hawley, P. M., ed., LippencottRaven), Philadelphia, 1996; Sedlmeier et al., 1998, Adv Virus Res 50:101-39).

In contrast to APV A and B and PVM and similar to RSV and APV-C the MPV P ORF lacks cysteine residues. A region of high similarity between all pneumoviruses (amino acids 185-241) plays a role in either the RNA synthesis process or in maintaining the structural integrity of the nucleocapsid complex (Ling et al., 1995, Virus Res 36:247-57). This region of high similarity is also found in MPV (FIG. 6) especifically when conservative substitutions are taken into account, showing 100% similarity with APYC, 93% with APV-A and B, and approximately 81% with RSV. The C-terminus of the MPV P protein is rich in glutamate residues as has been described for APVs (Ling, et al., 1995, Virus Res 36:247-57).

GENE ENCODING THE MATRIX (M) PROTEIN: The third ORF of the MPV genome encodes a 254 aa protein, which resembles the M ORFs of other pneumoviruses. The M ORF of MPV has exactly the same size as the M ORFs of other *metapnuemoviruses* and shows high aa sequence homology with the matrix proteins of APV (78-87%), lower homology with those of iRSV and PVM (37-38%), and 10% or less homology with those of other paramyxoviruses (Table 6).

The sequences of matrix proteins of all pneumoviruses were compared and a conserved heptadpeptide at residue 14 to 19 was found to also conserved in MPV (FIG. 7) (Easton et al 1997, Virus Res, 48:27-33). For RSV, PVM and APV, small secondary ORFs within or overlapping with the major ORF of M have been identified (52 aa and 51 aa in bRSV, 75 aa in RSV, 46 aa in PVM and 51 aa in APV) (Yu et al., 1992, Virology 186:426-34; Easton et al., 1997, Virus Res 48:27-33; Samal et al., 1991, J Gen Virol 72:715-20; Satake et al., 1995, J Virol 50:92-9). One small ORF of 54 aa residues was found within the major M ORF (fragment 1, FIG. 8), starting at nucleotide 2281 and one small ORF of 33 aa residues was found overlapping with the major ORF of M starting at nucleotide 2893 (fragment 2, FIG. 8). Similar to the secondary ORFs of RSV and APV there is no significant homology between these secondary ORFs and secondary ORFs of the other pneumoviruses, and apparent start or stop signals are lacking. Furthermore, there have not been any report of protein synthesis occurring from these secondary ORFs.

GENE ENCODING THE FUSION PROTEIN: The F ORF of MPV is located adjacent to the M ORF, a feature that is characteristic of members of the *Metapneumovirus* genus. The F gene of MPV encodes a 539 aa protein, which is two aa residues longer than F of APV-C. Analysis of the aa sequence revealed 81% homology with APV-C, 67% with APV-A and B, 33-39% with pneumovirus F proteins and only 10-18% with other paramyxoviruses (Table 6). One of the conserved features among F proteins of paramyxoviruses, and also seen in MPV is the distribution of cysteine residues (Morrison et al., 1988, Virus Res 10:113-35; Yu et al, 1991, J. Gen Virol 72:75-81). The *metapnuemoviruses* share 12 cysteine residues in E1 (7 are conserved among all paramyxoviruses), and two in E2 (1 is conserved among all paramyxoviruses). Of the 3 potential N-linked glycosylation sites present in the F ORF of MPV, none are shared with RSV and two (position 74 and 389) are shared with APV. The third, unique, potential N-linked glycosylation site for MPV is located at position 206 (FIG. 9).

Despite the low sequence homology with other paramyxoviruses, the F protein of MPV revealed typical fusion protein characteristics consistent with those described for the F proteins of other Paramyxoviridae family members (Morrison et. al., 1988, Virus Res 10:113-35). F proteins of Paramyxoviridae members are synthesized as inactive precursors (F0) that are cleaved by host cell proteases which generate amino terminal E2 subunits and large carboxy terminal F1 subunits. The proposed cleavage site (Collins et al., Fields virology, (B. N. Knipe, Howley, P. M., ed., Lippencott-Raven), Philadelphia, 1996) is conserved among all members of the Paramyxoviridae family. The cleavage site of MPV contains the residues RQSR. Both arginine (R) residues are shared with APV and RSV, but the glutamine (Q) and serine (S) residues are shared with other paramyxoviruses such as human parainfluenza virus type 1, Sendai virus and morbilliviruses.

The hydrophobic region at the amino terminus of F1 is thought to function as the membrane fusion domain and shows high sequence similarity among paramyxoviruses and morbilliviruses and to a lesser extent the pneumoviruses (Morrison et al., 1988, Virus Res 10:113-35). These 26 residues (position 137-163, FIG. 9) are conserved between MPV and APV-C, which is in agreement with this region being highly conserved among the *metapnuemoviruses* (Naylor et al., 1998, J. Gen Virol 79:1393-1398; Seal et al., 2000, Virus Res 66:139-47).

As is seen for the F2 subunits of APV and other paramyxoviruses, MPV revealed a deletion of 22 aa residues compared with RSV (position 107-128, FIG. 9). Furthermore, for RSV and APV, the signal peptide and anchor domain were found to be conserved within subtypes and displayed high variability between subtypes (Plows et al., 1995, Virus Genes 11:37-45; Naylor et al., 1998, J. Gen Virol 79:1393-1398). The signal peptide of MPV (aa 10-35, FIG. 9) at the amino terminus of F2 exhibits some sequence similarity with APV-C (18 out of 26 aa residues are similar), and less conservation with other APVs or RSV. Much more variability between subtypes is seen in the membrane anchor domain at the carboxy terminus of E1, although some homology is still seen with APV-C.

GENE ENCODING THE M2 PROTEIN: The M2 gene is unique to the Pneumovirinae and two overlapping ORFs have been observed in all pneumoviruses. The first major ORF represents the M2-1 protein which enhances the processivity of the viral polymerase (Collins et al., 1995, Proc Natl Acad Sci USA 92:11563-7; Collins et. al., Fields virology (B. N. Knipe, Howley, P. M., ed., Lippencott-Raven), Philadelphia, 1996) and its readthrough of intergenic regions (Hardy et al., 1998, J Virol 72:520-6; Feams et al., 1999, J Virol 73:5852-64). The M2-1 gene for MPV, located adjacent to the F gene, encodes a 187 aa protein, and reveals the highest (84%) homology with M2-1 of APV-C. Comparison of all pneumovirus M2-1 proteins revealed the highest conservation in the amino-terminal half of the protein (Collins et al., 1990, J. Gen Virol 71:3015-20; Zamora et al., 1992, J. Gen Virol 73:737-41; Ahmadian et al., 1999, J. Gen Virol 80:2011-6), which is in agreement with the observation that MPV displays 100% similarity with APV-C in the first 80 aa residues of the protein (FIG. 10). The MPV M2-1 protein contains 3 cysteine residues located within the first 30 aa residues that are conserved among all pneumoviruses. Such a concentration of cysteines is frequently found in zinc-binding proteins (Cuesta et al., 2000, Gen Virol:74, 9858-67).

The secondary ORFs (M2-2) that overlap with the M2-1 ORFs of pneumoviruses are conserved in location but not in sequence and are thought to be involved in the control of the switch between virus RNA replication and transcription (Collins et al., 1985, J Virol 54:65-71; Elango et al., 1985, J Virol 55:101-10; Baybutt et. al., 1987, J Gen Virol 68:2789-96; Collins et al., 1990, J. Gen Virol 71:3015-20; Ling et al., 1992, J. Gen Virol 73:1709-15; Zamora et al., 1992, J. Gen Virol 73:737-41; Alansari et al., 1994, J. Gen Virol:75:401-404; Ahmadian et al., 1999, J. Gen Virol 80: 2011-6). For MPV, the M2-2 ORF starts at nucleotide 512 in the M2-1 ORF (FIG. 8), which is exactly the same start position as for APV-C. The length of the M2-2 ORFs are the same for APV-C and MPV, 71 aa residues. Sequence comparison of the M2-2 ORF (FIG. 10) revealed 64% aa sequence homology between MPV and APV-C and only 44-48% aa sequence homology between MPV and APV-A and B.

SMALL HYROPHOBIC (SH) GENE ORF: The gene located adjacent to M2 of hMPV probably encodes a 183 aa SH protein (FIG. 8). There is no discernible sequence identity between this ORF and other RNA virus genes or gene products. This is not surprising since sequence similarity between pneumovirus SH proteins is generally low. The aa composition of the SH ORF is relatively similar to that of APV, RSV and PVM, with a high percentage of threonine and serune residues (22%, 18%, 19%, 20.0%, 21% and 28% for hMPV, APV, RSV A, RSV B, bRSV and PVM respectively). The SH ORF of hMPV contains 10 cysteine residues, whereas APV SH contains 16 cysteine residues. The SH ORF of hMPV contains two potential N-linked glycosylation sites (aa 76 and 121), whereas APV has one, RSV has two or three and PVM has four.

The hydrophilicity profiles for the putative hMPV SH protein and SH of APV and RSV revealed similar characteristics (FIG. 11B). The SH ORFs of APV and hMPV have a hydrophilic N-terminus, a central hydrophobic domain which can serve as a potential membrane spanning domain (aa 30-53 for hMPV), a second hydrophobic domain (aa 155-170) and a hydrophilic C-terminus. In contrast, RSV SH appears to lack the C-terminal part of the APV and hMPV ORFs. In all pneumovirus SH proteins the hydrophobic domain is flanked by basic aa residues, which are also found in the SH ORF for hMPV (aa 29 and 54).

GENE ENCODING THE ATTACHMENT GLYCOPROTEIN (G): The putative G ORF of hMPV is located adjacent to the putative SH gene and encodes a 236 as protein (nt 6262-6972, FIG. 8). A secondary small ORF is found immediately following this ORF, potentially coding for 68 aa residues (nt 6973-7179) but lacking a start codon. A third potential ORF in the second reading frame of 194 aa residues is overlapping with both of these ORFs but also lacks a start codon (nt 6416-7000). This ORF is followed by a potential fourth ORF of 65 aa residues in the same reading frame (nt 7001-7198), again lacking a start codon. Finally, a potential ORF of 97 aa residues (but lacking a start codon) is found in the third reading frame (nt 6444-6737, FIG. 8). Unlike the first ORF, the other ORFs do not have apparent gene start or gene end sequences (see below). Although the 236 aa G ORF probably represents at least a part of the hMPV attachment protein it can not be excluded that the additional coding sequences are expressed as separate proteins or as part of the attachment protein through some RNA editing event. It should be noted that for APV and RSV no secondary ORFs after the primary G ORF have been identified but that both APV and RSV have secondary ORFs within the major ORF of G. However, evidence for expression of these ORFs is lacking and there is no sequence identity between the predicted aa sequences for different viruses (Ling et al., 1992, J Gen Virol 73:1709-15). The secondary ORFs in hMPV G do not reveal characteristics of other G proteins and whether the additional ORFs are expressed requires further investigation.

BLAST analyses with all ORFs revealed no discernible sequence identity at the nucleotide or aa sequence level with other known virus genes or gene products. This is in agreement with the low percentage sequence identity found for other G proteins such as those of hRSV A and B (53%) (Johnson et al., 1987, J Virol 61:163-6) and APV A and B (38%) (Juhasz and Easton, 1994, J Gen Virol 75:2873-80).

Whereas most of the hMPV ORFs resemble those of APV both in length and sequence, the putative G ORF of 236 aa residues of hMPV is considerably smaller than the G ORF of APV (Table 4). The aa sequence revealed a serine and threonine content of 34%, which is even higher than the 32% for RSV and 24% for APV. The putative G ORF also contains 8.5% proline residues, which is higher than the 8% for RSV and 7% for APV. The unusual abundance of proline residues in the G proteins of APV, RSV and hMPV has also been observed in glycoproteins where it is a major determinant of the proteins three dimensional structure (Collins and Wertz, 1983, PNAS 80:3208-12; Wertz et al., 1985, PNAS 82:4075-9; Jentoft, 1990, Trends Biochem Sci 15:291-4.). The G ORF of hMPV contains five potential N-linked glycosylation sites, whereas hRSV has seven, bRSV has five and APV has three to five.

The predicted hydrophilicity profile of hMPV G revealed characteristics similar to the other pneumoviruses. The N-tenminus contains a hydrophilic region followed by a short hydrophobic area (aa 33-53 for hMPV) and a mainly hydrophilic C-terminus (FIG. 12B). This overall organization corresponds well with regions in the G protein of APV and RSV. The putative G ORF of hMPV contains only 1 cysteine residue in contrast to RSV and APV (5 and 20 respectively). Of note, only two of the four secondary ORFs in the G gene contained one additional cysteine residue and these four potential ORFs revealed 12-20% serine and threonine residues and 6-11% proline residues.

POLYMERASE GENE (L): In analogy to other negative strand viruses, the last ORF of the MPV genome is the RNA-dependent RNA polymerase component of the replication and transcription complexes. The L gene of MPV encodes a 2005 aa protein, which is one residue longer than the APV-A protein (Table 5). The L protein of MPV shares 64% homology with APV-A, 42-44% with RSV, and approximately 13% with other paramyxoviruses (Table 6). Six conserved domains within the L proteins of non-segmented negative strand RNA viruses were identified; it was found that the domain three contained the four core polymerase motifs that are thought to be essential for polymerase function (Poch et al., 1990, J Gen Virol 71:1153-62; Poch et al., 1989, EMBO J 8:3867-74). These motifs (A, B, C and D) are well conserved in the MPV L protein: in motifs A, B and C: MPV shares 100% similarity with all pneumoviruses and in motif D MPV shares 100% similaritywith APV and 92% with RSVs. For all of domain III (aa 627-903 in the L ORF), MPV shares 77% identity with APV, 61-62% with RSV and 23-27% with other pararnyxoviruses (FIG. 13). In addition to the polymerase motifs the pneumovirus L proteins contain a sequence which conforms to a consensus ATP binding motif $K(X)_{21}GE$-$GAGN(X)_{20}K$ (Stec et al., 1991, Virology 183:273-87). The MPV L ORF contains a similar motif as APV, in which the spacing of the intermediate residues is shifted by one residue: $K(X)_{22}GEGAGN(X)_{19}K$.

TABLE 5

LENGTHS OF THE ORFs OF MPV AND OTHER PARAMYXOVIRUSES

|         | N[1]    | P       | M       | F       | M2-1 | M2-2 | SH   | G    | L         |
|---------|---------|---------|---------|---------|------|------|------|------|-----------|
| MPV     | 394     | 294     | 254     | 539     | 187  | 71   | 183  | 236  | 2005      |
| APV A   | 391     | 278     | 254     | 538     | 186  | 73   | 174  | 391  | 2004      |
| APV B   | 391     | 279     | 254     | 538     | 186  | 73   | **   | 414  | **        |
| APV C   | 394     | 294     | 254     | 537     | 184  | 71   | **   | **   | **        |
| APV D   | **      | **      | **      | **      | **   | **   | **   | 389  | **        |
| hRSV A  | 391     | 241     | 256     | 574     | 194  | 90   | 64   | 298  | 2165      |
| hRSV B  | 391     | 241     | 249     | 574     | 195  | 93   | 65   | 299  | 2166      |
| bRSV    | 391     | 241     | 256     | 569     | 186  | 93   | 81   | 257  | 2162      |
| PVM     | 393     | 295     | 257     | 537     | 176  | 77   | 92   | 396  | **        |
| others[3] | 418-542 | 225-709 | 335-393 | 539-565 | **** | **** | **** | **** | 2183-2262 |

Legend for Table 5:
* = length in amino acid residues,
** = sequences not available,
*** = others: human parainfluenza virus type 2 and 3, Sendai virus, measles virus, nipah virus, phocine distemper virus, and New Castle Disease virus,
**** = ORF not present in viral genome.

TABLE 6

AMINO ACID SEQUENCE IDENTITY BETWEEN THE ORFs OF MPV AND THOSE OF OTHER PARAMYXOVIRUSES

|         | N    | P   | M    | F     | M2-1 | M2-2 | L     |
|---------|------|-----|------|-------|------|------|-------|
| APV A   | 69   | 55  | 78   | 67    | 72   | 26   | 64    |
| APV B   | 69   | 51  | 76   | 67    | 71   | 27   | **    |
| APV C   | 88   | 68  | 87   | 81    | 84   | 56   | **    |
| hRSV A  | 42   | 24  | 38   | 34    | 36   | 18   | 42    |
| hRSV B  | 41   | 23  | 37   | 33    | 35   | 19   | 44    |
| bRSV    | 42   | 22  | 38   | 34    | 35   | 13   | 44    |
| PVM     | 45   | 26  | 37   | 39    | 33   | 12   | **    |
| others[3] | 7-11 | 4-9 | 7-10 | 10-18 | **** | **** | 13-14 |

Legend for Table 6:
* = No sequence homologies were found with known G and SH proteins and were thus excluded,
** = Sequences not available,
* = See list in table 4, denoted by same (*),
**** = ORF absent in viral genome.

6.5 EXAMPLE 5

Genomic Sequencing of HMPV Isolate 1-99

Another isolate of hMPV (1-99) was also identified and sequenced. In order to do so, the hMPV isolate 1-99 was propagated on tertiary monkey kidney cells exactly as described before (van den Hoogen et al., 2001, Nature Medicine 7(6):719-724). Viral RNA was isolated using the MagnaPure LC isolation system (Roche Applied Science) and the total nucleic acid kit protocol. RNA was converted into cDNA using standard protocols, with random hexamers (Progema Inc. Leiden) as primers. This cDNA was kept at −20° C. or lower until used for sequence analysis. Primers used throughout this project were based on the sequences available from the prototype hMPV 1-00 strain, or obtained after sequence analysis using the hMPV strain 1-99.

PCR fragments were made ranging in size up to 1600 base-pairs to generate overlapping fragments. Sequence analysis was performed on the PCR fragments using standard technology and an ABI 3100 capillary sequence instrument (Applied Biosystems, Nieuwerkerk Issel). The nucleotide sequences generated were compared initially with the prototype hMPV strain 1-00 for comparison. Blast software was used for comparison with related sequences in the GenBank database. For further analysis of the sequences, DNASTAR software was used (DNASTAR Inc, Madison Wis., U.S.A.) and for phylogenetic analysis, the ClustalW software program was used.

Initially, sequences for the 1-99 isolate were obtained using primers that were designed based on sequence information from the 1-00 isolate. However, since some parts of the genome could not be sequenced based on the information from the 1-00 isolate, new primers based on sequence information from the 1-99 isolate, as well from information made available through the sequencing of the 3' and 5' end of the 1-00 isolate, were used.

The prototype sequence of the hMPV isolate 1-99 contained 13,223 base-pairs, sequenced in a total of 227 individual sequences, with an average length of 404 base-pairs. The sequence is SEQ ID NO:18.

The length of the open reading frames of hMPV 1-99 and other Paramyxoviruses, both in absolute size and percentage amino acid identity are shown in Table 7. Most identity between the 1-99 and 1-00 strains was observed in the genes coding for N protein (95.2%), M (97.3%), F (93.7%), L (94.1%) and M2-1 (94.1%) with percentages homology of over 90%. The homology of the P and M2-2 genes between both strains was found to be 86.1 and 88.9% respectively. Also, the isolate is mostly related to the subtype C of the avian *Metapnuemovirus*, with amino acid identities in the N protein (88.6%), M protein (87.1%) and M2-1 protein (84.3%). The identity with the P and M2-2 proteins is lower at 67.8% and 56.9% respectively.

The genes of the prototype 1-00 and 1-99 strains are identical on the genomic map, with the same number of amino acids for N, P, M, F, M21 and M2-2 protein. The putative SH gene is 6 amino acids shorter, the G protein is 12 amino acids shorter, and the L gene of the 1-00 and 1-99 strain are the same size.

Finally, the start of the genes on the genomic map and the non-coding sequences located between the genes, have been summarized in Table 8.

In summary, the sequence information of the 1-99 strain of the human *Metapnuemovirus* clearly demonstrates the genetic relation of 1-99 with the prototype strain 1-00, sharing identical genomic map organization. Less phylogenetic relation is observed with the subtype C of APV.

TABLE 7

LENGTH OF THE ORFS OF HMPV 1-99 AND OTHER PARAMYXOVIRUSES (NO. OF AMINO ACID RESIDUES)

| | N | P | M | F | M21 | M22 | SH | G | L |
|---|---|---|---|---|---|---|---|---|---|
| 1-99 | 394 | 294 | 254 | 539 | 187 | 71 | 177 | 224 | 1937 |
| 1-00 | 394 | 294 | 254 | 539 | 187 | 71 | 183 | 236 | 2005 |
| APV-A | 391 | 278 | 254 | 538 | 186 | 73 | 174 | 391 | 2004 |
| APV-B | 391 | 279 | 254 | 538 | 186 | 73 | | 414 | |
| APV-C | 394 | 294 | 254 | 537 | 184 | 71 | | | |
| hRSV-A | 391 | 241 | 256 | 574 | 194 | 90 | 64 | 298 | 2165 |
| hRSV-B | 391 | 241 | 256 | 574 | 195 | 90 | 65 | 299 | 2166 |
| bRSV | 391 | 241 | 256 | 574 | 186 | 90 | 81 | 257 | 2162 |
| PVM | 393 | 295 | 257 | 537 | 176 | 98 | 92 | 396 | |

TABLE 7-continued

PERCENTAGE OF THE AMINO ACID SEQUENCE IDENTITY BETWEEN HMPV 1-99 AND OTHER PARAMYXOVIRUSES

| | N | P | M | F | M21 | M22 | SH | G | L |
|---|---|---|---|---|---|---|---|---|---|
| 1-00 | 95.2 | 86.1 | 97.3 | 93.7 | 94.1 | 88.9 | 59 | 32.4 | 94.1 |
| APV-A | 68.9 | 58.1 | 76.1 | 67.5 | 69 | 25 | 13.1 | 14.2 | 63.7 |
| APV-B | 69.1 | 53.9 | 76.5 | 66.8 | 65.8 | 26.4 | | | |
| APV-C | 88.6 | 67.8 | 87.1 | 80.5 | 84.3 | 56.9 | | | |
| bRSV | 41.1 | 28.1 | 36.9 | 35 | 32.6 | 9.7 | 12.2 | 15.6 | 46.5 |
| hRSV-A | 41.1 | 26 | 37.6 | 32.2 | 35.6 | | 6.2 | 16 | 46.9 |
| hRSV-B | 40.6 | 26 | 36.9 | 34.4 | 34 | 13.9 | 21.2 | 15.6 | 47 |
| PVM | 43.7 | 22.4 | 39.2 | 38.8 | | | 5.4 | 8 | |

TABLE 8

SUMMARY OF GENE START SEQUENCES ON THE GENOMIC MAP AND THE NON-CODING SEQUENCES LOCATED BETWEEN THE GENES.

| Pos. | ORF | Stop | Non-coding sequence | Gene start | Start | Pos | ORF |
|---|---|---|---|---|---|---|---|
| 1 | Le | | ACGAGAAAAAAACGCGUAUAAAUUAAAU UCCAAACAAAAC | GGGACAAAUAAAA | AUG | 54 | N |
| 1238 | N | UAA | UUAAAAAACU | GGGACAAGUCAAA | AUG | 1262 | P |
| 2146 | P | UAG | UUUAAUAAAAAUAAACAAU | GGGACAAGUCAAG | AUG | 2179 | M |
| 2943 | M | UAA | AAAUAACUGUCUUAAUCAAUAAUUGCUU | GGGACAAAUAAAA | AUG | 3065 | F |
| | | | AUAUAACUCUAG AGAUUAAUAAGCUUAUUAUUAUAGUUAU | | | | |
| | | | AUAAAAAUAAAU UAGAAUUAGAAGGGCAUCAAUAGAAAGC | | | | |
| 4684 | F | UAG | UUAAUUAAAAAU | GGGACAAAUCAUC | AUG | 4711 | M2 |
| 5437 | M2 | UAG | UAAAAAAUAAAAAAUAGAAU | GGGAUAAAUGACA | AUG | 5470 | SH |
| 6003 | SH | UAA | AAUAACACGGSUUUSAACAUUAAAAUSA | GGGACAAGUGGCU | AUG | 6210 | G |
| | | | GAACAACCUCCA CCCAGGUCUAUCAAUACAGUGGUUUAG | | | | |
| | | | CCAUUUAAAAACC GAAUAUUAUCUAGGCUGCACGACACUUU | | | | |
| | | | GCAAUAAUAUGC AAUAGUCAAUAGUUAAACCACUGCUGCA | | | | |
| | | | AACUCAUCCAUA AUAUAAUCACUGAGUAAUACAAAACAAG | | | | |
| | | | AAAAU | | | | |
| 6884 | G | UAG | AGAGGUGCAAAACUCAAAUGAGCACAAC | GGGAUAAAUGACA | AUG | 7124 | L |
| | | | ACACAAACAUYC CAUCCAAGUAGUUAACAAAAAACCACAA | | | | |
| | | | AAUAACCUUGAA AACCAAAAAACCAAAACAUAAACCCAGA | | | | |
| | | | CCCAGAAAAACA UAGACACCAUAUGGAAGGUUCUAGCAUA | | | | |
| | | | UGCACCAAUGAG AUGGCAUCUGUUCAUGUAUCAAUAGCAC | | | | |
| | | | CACCAUCAUUCA AGGAAUAAGAAGAGGCGAAAAUUUAA | | | | |

TABLE 8-continued

SUMMARY OF GENE START SEQUENCES ON THE GENOMIC MAP AND
THE NON-CODING SEQUENCES LOCATED BETWEEN THE GENES.

| Pos. | ORF | Stop | Non-coding sequence | Gene start | Start | Pos | ORF |
|---|---|---|---|---|---|---|---|
| 13009 | L | UGA | AUUAAACUAUGAUUUCUUUGAAGCAUUA | | AUG | 13243 | Tr |
| | | | GAGAACACAUAC | | | | |
| | | | CCCAAUAUGAUCAAGCUUAUAGAUAAUU | | | | |
| | | | UGGGAAAUGCAG | | | | |
| | | | AAAUAAAGAAACUAAUCMAGGUCMCUG | | | | |
| | | | GGUAUAUGCUUGU | | | | |
| | | | GAGUAAGAAGUAAUAAUAAUGAUAAUGA | | | | |
| | | | UUAACCAUAAUC | | | | |
| | | | UCMCMCMACUGAGAAAAUAAUCGUCUA | | | | |
| | | | ACAGUUUAGUUGA | | | | |
| | | | UCAUUAGUUAUUUAAAAUUAUAAAAUAG | | | | |
| | | | UAACUA | | | | |

6.6 EXAMPLE 6

Phylogenetic Relationships

Phylogenetic approaches can be used in order to identify the relationships among groups of viruses, i.e. between MPV and other viruses. Additionally, phylogenetic relationships can be determined for different isolates of the same type of virus. Phylogenetic trees were determined to determine relationships between MPV and other viruses, and also to determine relationships between the different isolates of hMPV. For example, phylogenetic trees can be generated, using nucleotide or protein sequence data, in order to illustrate the relationship between MPV and different viruses. Alternatively, phylogenetic trees can be generated, using nucleotide or protein sequence data, in order to illustrate the relationship between various isolates of hMPV.

PHYLOGENETIC RELATIONSHIPS BETWEEN HMPV AND DIFFERENT VIRUSES: Although BLAST searches using nucleotide sequences obtained from the unidentified virus isolates revealed homologies primarily with members of Pneumovirinae, homologies that were based on protein sequences revealed some resemblance with other paramyxoviruses as well. As an indication of the relationship between the newly identified virus isolates and members of Pneumovirinae, phylogenetic trees were constructed based on the N, P, M and F ORFs of these viruses. In all four phylogenetic trees, the newly identified virus isolate was most closely related to APV (FIG. 14). From the four serotypes of APV that have been described (Bayon-Auboyer et al., 2000, J Gen. Virol 81:2723-2733), APV serotype C, the metapnuemovirus found primarily in birds in the USA, showed the closest resemblance to the newly identified virus. It should be noted however, that only partial sequence information for APV serotype D is available.

For all phylogenetic trees, DNA sequences were aligned using the ClustalW software package and maximum likelihood trees were generated using the DNA-ML software package of the Phylip 3.5 program using 50 or 100 bootstraps and 3 jumbles (Brandenburg et al., 1997, J Med Virol 52:97-104). Previously published sequences that were used for the generation of phylogenetic trees are available from Genbank under accessions numbers: For all ORFs: hRSV: NC001781; bRSV: NC001989; For the F ORF: PYM, D11128; MV-A, D00850; MV-B, Y14292; MV-C, AF187152; For the N ORF: PVM, D10331; MV-A, U39295; MV-B, U39296; MV-C, M176590; For the M ORF: PMV, U66893; MV-A, X58639; MV-B, U37586; MV-C, AE262571; For the P ORF: PVM, 09649; MV-A, U22110, MV-C, AF176591.

As an indicator of the relationship between MPV and members of the Pneumovirinae, phylogenetic trees based on the N, P, M, and F ORFs were constructed previously (van den Hoogen et al., 2001, Nat Med 7(6):19-24) and revealed a close relationship between MPV and APV-C. Because of the low homology of the MPV SH and G genes with those genes of other paramyxoviruses, reliable phylogenetic trees for these genes cannot be constructed. In addition, the distinct genomic organization between members of the Pneunmovirus and Metapnuemovirus genera make it impossible to generate phylogenetic trees based on the entire genomic sequence. Trees for the M2 and L genes were constructed in addition to those previously published. Both these trees confirmed the close relation between APV and MPV within the Pneumovirinae subfamily (FIG. 15).

To construct phylogenetic trees, DNA sequences were aligned using the ClustalW software package and maximum likelihood trees were generated using the DNA-ML software package of the Phylip 3.5 program using 100 bootstraps and 3 jumbles. Bootstrap values were computed for consensus trees created with the PHYLIP consensus package.

Based upon phylogenetic analyses of the different isolates of hMPV obtained so far, two major genotypes have been identified with virus isolate 00-1 being the prototype of genotype A and isolate 99-1 the prototype of genotype B.

It is hypothesized that the genotypes are related to subtypes and that re-infection with viruses from both subgroups occur in the presence of pre-existing immunity and the antigenic variation may not be strictly required to allow re-infection. Furthermore, hMPV appears to be closely related to avian pneumovirus, a virus primarily found in poultry. The nucleotide sequences of both viruses show high percentages of homology, with the exception of the SH and G proteins. The viruses appear to cross-react in tests that are based primarily on the nucleoprotein and matrixprotein, however, they respond differently in tests that are based on the attachment proteins. The differences in virus neutralization titer provide further proof that the two genotypes of hMPV are two different serotypes of one virus, where APV is a different virus.

PHYLOGENETIC RELATIONSHIPS BETWEEN DIFFERENT HMPV ISOLATES: Phylogenetic approaches can also be used in order to identify the relationships among different isolates of MPV. For example, phylogenetic trees can be generated, using nucleotide or protein sequence data of MPV, in order to illustrate the relationship between a number of MPV isolates that are obtained from different subjects. This approach is useful in understanding the differences that occur within the population of MPV viruses.

To determine the relationship of our various newly identified virus isolates, phylogenetic trees were constructed based on sequence information obtained from eight to nine isolates (8 for F, 9 for N, M and L). RT-PCR was used with primers designed to amplify short fragments in the N, M, F, P, SH and L ORFs, that were subsequently sequenced directly. The nine virus isolates that were previously found to be related in serological terms (see above) were also found to be closely related genetically. In fact, all nine isolates were more closely related to one another than to APV. Although the sequence information used for these phylogenetic trees was limited, it appears that the nine isolates can be divided in two groups, with isolate 94-1, 99-1 and 99-2 clustering in one group and the other six isolates (94-2; 93-1; 93-2; 93-3; 93-4; 00-1) in the other (FIG. 16).

An alignment of the F genes of different isolates of hMPV of all four variants, variant A1, A2, B1, or B2, is shown in FIG. 17.

An alignment of the F proteins of different isolates of hMPV of all four variants, variant A1, A2, B1, or B2, is shown in FIG. 18.

An alignment of the G genes of different isolates of hMPV of all four variants, variant A1, A2, B1, or B2, is shown in FIG. 19.

An alignment of the G proteins of different isolates of hMPV of all four variants, variant A1, A2, B1, or B2, is shown in FIG. 20.

A phylogenetic tree based on the F gene sequences showing the phylogenetic relationship of the different hMPV isolates and their association with the respective variants of hMPV is shown in FIG. 21. Further, a phylogenetic tree based on the G gene sequences showing the phylogenic relationship of the different hMPV isolates and their association with the respective variants of hMPV is shown in FIG. 22. The phylogenetic trees were calculated using DNA maximum likelihood with 50 bootstraps and 3 jumbles.

Sequence identities between different genes of hMPV isolate 00-1 with different genes of hMPV isolate 99-1, APV serotype C, and APV serotype A are listed in Table 9.

TABLE 9

ORF SEQUENCE IDENTITY BETWEEN HMPV ISOLATE 00-1 AND OTHER VIRUSES

| | N | P | M | F | M2.1 | M2.2 | SH | G | L |
|---|---|---|---|---|---|---|---|---|---|
| hMPV isolate 99-1 | 95 | 86 | 98 | 94 | 95 | 90 | 57 | 33 | 94 |
| APV serotype C | 88 | 68 | 87 | 81 | 84 | 56 | N.A. | N.A. | N.A. |
| APV serotype A | 69 | 55 | 78 | 68 | 72 | 25 | 18 | 9 | 64 |

Originally, phylogenetic relationships were inferred for only nine different isolates. Two potential genetic clusters were identified by analyses of partial nucleotide sequences in the N, M, F and L ORFs of virus isolates. Nucleotide identity of 90-100% was observed within a cluster, and 81-88% identity was observed between the clusters. Sequence information obtained on more virus isolates confirmed the existence of two genotypes. Virus isolate 00-1, as a prototype of cluster A, and virus isolate 99-1 as a prototype of cluster B, have been used in cross neutralization assays to test whether the genotypes are related to different serotypes or subgroups.

Using RT-PCR assays with primers located in the polymerase gene, thirty additional virus isolates were identified from nasopharyngeal aspirate samples. Sequence information of parts of the matrix and polymerase genes of these new isolates together with those of the previous nine isolates were used to construct phylogenetic trees (FIG. 15). Analyses of these trees confirmed the presence of two genetic clusters, with virus isolate 00-1, as the prototype virus in group A and virus isolate 99-1 as the prototype virus in group B. The nucleotide sequence identity within a group was more than 92%, while between the clusters the identity was 81-85%.

6.7 EXAMPLE 7

Leader Sequences of Human *Metapnuemovirus* (HMPV) NL/1/00 Genomic RNA

While the majority of genomic composition was determined, the authentic terminal sequences at the extreme ends were lacking. Using ligation of the viral RNA and subsequent PCR amplification of the ligated junction and a combination of polyadenylation and 3' RACE methods, the authentic nucleotide sequences were determined (FIG. 54). The sequence analysis of PCR fragments generated by ligation of viral RNA ends revealed the Leader and Trailer sequences displayed in FIG. 26 (See, SEQ IDs 18-21). The trailer sequences obtained this way were consistent with the sequences expected from the trailer sequences of other pramyxoviruses, including APV. However, the leader sequence of only 2 out of 71 clones sequenced, contained AC as the terminal nucleotide residues that are found in all paramyxoviruses to date. Therefore, the terminal nucleotide sequences of the hMPV/NL/1/00 leader were subsequently confirmed using a combination of polyadenylation and 3' RACE methods. Furthermore, two extra nucleotides at the 3' leader terminus of hMPV NL/1/00 were identified.

Vero-grown hMPV NL/1/00 virus was used in this study. As a control, a related negative sense RNA virus, respiratory syncytial virus (RSV) A2, that has a similar genomic size with identified terminal sequences, was included. Viral RNA was isolated using the QIAamp Viral RNA Mini Kit (Qiagen), following the manufacturer's instructions.

Viral RNA was polyadenylated by incubating the viral RNA with poly (A) polymerase (Ambion) at 37° C. for 1 hr, followed by clean up using a NucAway spin column (Ambion). The viral RNA was then reverse transcribed using a primer complementary to the poly (A) tail region and the reverse transcriptase, Superscript I (Invitrogen). PCR and Nested PCR reactions were carried out using hMPV specific primers, juxtaposed to the terminal ends, to amplify the desired products with expected sizes for sequencing analysis. PCR products were further cloned into pCRII vector using a TA cloning kit (Invitrogen). To reveal the authentic nucleotide sequences for the terminus, direct sequencing of PCR DNA as well as the cloned PCR products were conducted.

Only hMPV data are shown in FIG. 55. Control experiments, using RSV-A2 RNA, indicated that the leader sequences of RSV-A2 remained intact and detectible with the same approach. Sequencing analyses on PCR products directly (FIG. 55) and on PCR clones both indicated that the leader region of hMPV consisted of 5' ACG CGA AAA AAA CGC GTA TA (expressed as positive sense cDNA orientation) at the 3' most proximal 20 nucleotides in the leader sequence. The two newly identified nucleotides are underlined in FIG. 101.

6.8 EXAMPLE 8

Serotyping and Subgrouping of MPV Isolates

Virus neutralization assays (See, e.g., Example 16) were used to determine if the virus isolates of hMPV could be distingushed by serotype or genotype. Virus isolates 00-1 and 99-1 were used to inoculate ferrets in order to raise virus-specific antisera. For the 00-1 isolate, ferret and guinea pig specific antisera for the virus were generated by experimental intranasal infection of two specific pathogen free ferrets and two guinea pigs, housed in separate pressurized glove boxes. Two to three weeks later all the animals were bled by cardiac puncture, and their sera were used as reference sera. The sera were tested for all previous described viruses with indirect IFA as described below. These antisera, along with antisera prepared using the 99-1 isolate, were used in virus neutralization assays with both viruses (Table 10).

TABLE 10

VIRUS NEUTRALIZATION TITERS

|  | ISOLATE 00-1 | ISOLATE 99-1 |
| --- | --- | --- |
| PRESERUM FERRET A (00-1) | 2 | 2 |
| FERRET A 22 DPI (00-1) | 64 | 2 |
| PRESERUM FERRET B (99-1) | 2 | 2 |
| FERRET B 22 DPI (99-1) | 4 | 64 |

For isolate 00-1 the titer differs 32 (64/2) fold
For isolate 99-1 the titer differs 16 (64/4) fold In addition, six guinea pigs were inoculated with either one of the viruses, i.e., 00-1 and 99-1). RT-PCR assays on nasopharyngeal aspirate samples showed virus replication from day 2 through day 10 post infection. At day 70 post infection the guinea pigs were challenged with either the homologous or the heterologous virus, and in all four cases virus replication was noticed.

Virus neutralization assays with anti sera after the first challenge showed essentially the same results as in the VN assays performed with the ferrets (>16-fold difference in VN titer).

The results presented in this example confirm the existence of two genotypes, that correspond to two serotypes of MPV, and show the possibility of repeated infection with heterologous and homologous virus (Table 11).

TABLE 11

|  | primary infection | virus replication | secondary infection | virus replication |
| --- | --- | --- | --- | --- |
| guinea pig 1-3 | 00-1 | 2 out of 3 | 99-1 | 1 out of 2 |
| guinea pig 4-6 | 00-1 | 3 out of 3 | 00-1 | 1 out of 3 |
| guinea pig 7-9 | 99-1 | 3 out of 3 | 00-1 | 2 out of 2 |
| guinea pig 10-12 | 99-1 | 3 out of 3 | 99-1 | 1 out of 3 |

Note:
for the secondary infection guinea pig 2 and 9 were not there any more.

7. Diagnostic Assays/Detection Methods

7.1 EXAMPLE 9

Direct Immunofluoresence Assay (DIF) Method

Nasopharyngeal aspirate samples from patients suffering from RTI were analyzed by DIF as described (Rothbarth et. al., 1999, J. of Virol. Methods 78:163-169). Samples were stored at −70° C. In short, nasopharyngeal aspirates were diluted with 5 ml Dulbecco MEM (Bio Whittaker, Walkersville, Md.) and thoroughly mixed on a vortex mixer for one minute. The suspension was centrifuged for ten minutes at 840×g. The sediment was spread on a multispot slide (Nutacon, Leimuiden, The Netherlands) and the supernatant was used for virus isolation. After drying, the cells were fixed in acetone for one minute at room temperature. After the slides were washed, they were incubated for 15 minutes at 37° C. with commercially available FITC-labeled anti-sera specific for viruses such as influenza A and B, hRSV and hPIV 1 to 3 (Dako, Glostrup, Denmark). After three washings in PBS and one in tap water, the slides were submerged in a glycerol/PBS solution (Citifluor, UKO, Canterbury, UK) and covered. The slides were then analyzed using a Axioscop fluorescence microscope.

7.2 EXAMPLE 10

Virus Culture of MPV

The detection of the virus in a cultivated sample from a host is a direct indication of the host's current and/or past exposure or infection with the virus.

Samples that displayed CPE after the first passage were used to inoculate sub-confluent mono-layers of tMK cells in media in 24 well plates. Cultures were checked for CPE daily and the media was changed once a week. Since CPE differed for each isolate, all cultures were tested at day 12 to 14 with indirect IFA using ferret antibodies against the new virus isolate. Positive cultures were freeze-thawed three times, after which the supernatants were clarified by low-speed centrifugation, aliquoted and stored frozen at −70° C. The 50% tissue culture infectious doses ($TCID_{50}$) of virus in the culture supernatants were determined as described (Lennette, D. A. et al. In: DIAGNOSTIC PROCEDURES FOR VIRAL, RICKETTSIAL, AND CHLAMYDIAL INFECTIONS, 7th ed. (eds. Lennette, E. H., Lennette, D. A. & Lennette, E. T.) 3-25; 37-138; 431-463; 481-494; 539-563 (American Public Health Association, Washington, 1995)).

7.3 EXAMPLE 11

Antigen Detection by Indirect Immunofluoresence Assays (IFA)

Antibodies can be used to visualize viral proteins in infected cells or tissues. Indirect immunofluorescence assay (IFA) is a sensitive approach in which a second antibody coupled to a fluorescence indicator recognizes a general epitope on the virus-specific antibody. IFA is more advantageous than DIF because of its higher level of sensitivity.

In order to perform the indirect IFA, collected specimens were diluted with 5 ml Dulbecco MEM medium (Bio Whittaker, Walkersville, Md.) and thoroughly mixed on a vortex mixer for one minute. The suspension was then centrifuged for ten minutes at 840×g. The sediment was spread on a multispot slide. After drying, the cells were fixed in acetone for 1 minute at room temperature. Alternatively, virus was cultured on tMK cells in 24 well slides containing glass slides. These glass slides were washed with PBS and fixed in acetone for 1 minute at room temperature.

Two indirect IFAs were performed. In the first indirect IFA, slides containing infected tMK cells were washed with PBS, and then incubated for 30 minutes at 37° C. with virus specific antisera. Monoclonal antibodies against influenza A, B and C, hPIV type 1 to 3, and hRSV were used. For hPIV type 4, mumps virus, measles virus, sendai virus, simian virus type 5, and New-Castle Disease virus, polyclonal antibodies (RIVM) and ferret and guinea pig reference sera were used. After three washings with PBS and one wash with tap water, the slides were stained with secondary antibodies directed against the sera used in the first incubation. Secondary antibodies for the polyclonal antisera were goat-anti-ferret (KPL, Guilford, UK, 40 fold diluted), mouse-anti-rabbit (Dako, Glostrup, Denmark, 20 fold diluted), rabbit-anti-chicken (KPL, 20 fold dilution) and mouse-anti-guinea pig (Dako, 20 fold diluted).

In the second IFA, after washing with PBS, the slides were incubated for 30 minutes at 37° C. with 20 polyclonal antibodies at a dilution of 1:50 to 1:100 in PBS. Immunized ferrets and guinea pigs were used to obtain polyclonal antibodies, but these antibodies can be raised in various animals, and the working dilution of the polyclonal antibody can vary for each immunization. After three washes with PBS and one wash with tap water, the slides were incubated at 37° C. for 30 minutes with FITC labeled goat-anti-ferret antibodies (KPL, Guilford, UK, 40 fold diluted). After three washes in PBS and one in tap water, the slides were included in a glycerol/PBS solution (Citifluor, UKO, Canterbury, UK) and covered. The slides were analyzed using an Axioscop fluorescence microscope (Carl Zeiss B. V., Weesp, the Netherlands).

7.4 EXAMPLE 12

Haemagglutination Assays, Chloroform Sensitivity Tests and Electron Microscopy

Different characteristics of a virus can be utilized for the detection of the virus. For example, many virus contain proteins that can bind to erythrocytes resulting in a lattice. This property is called hemagglutination and can be used in hemagglutination assays for detection of the virus. Virus may also be visualized under an electron microscope (EM) or detected by PCR techniques.

Hemagglutination assays and chloroform sensitivity tests were performed as described (Osterhaus et al., 1985, *Arch.of Virol* 86:239-25; Rothbarth et al., J of Virol Methods 78:163-169).

For EM analyses, virus was concentrated from infected cell culture supernatants in a micro-centrifuge at 4° C. at 17000× g, after which the pellet was resuspended in PBS and inspected by negative contrast EM.

7.5 EXAMPLE 13

Detection of hMPV/AVP Antibodies of IgG, IgA and IgM Classes

Specific antibodies to viruses rise during the course of infection/illness. Thus, detection of virus-specific antibodies in a host is an indicator of current and/or past infections of the host with that virus.

The indirect enzyme immunoassay (EIA) was used to detect the IgG class of hMPV antibodies. This assay was performed in microtitre plates essentially as described previously (Rothbarth et al., 1999, J. of Vir. Methods 78:163-169). Briefly, concentrated hMPV was solubilized by treatment with 1% Triton X-100. After determination of the optimal working dilution by checkerboard titration, it was coated for 16 hr at room temperature into microtitre plates in PBS. Subsequently, 100 ul volumes of 1:100 diluted human serum samples in EIA buffer were added to the wells and incubated for 1 hour at 37° C. Binding of human IgG was detected by adding a goat anti-human IgG peroxidase conjugate (Biosource, USA), adding TMB as substrate developed plates and Optical Density (OD) was measured at 450 nm. The results were expressed as the S(ignal)/N(egative) ratio of the OD. A serum was considered positive for IgG if the S/N ratio was beyond the negative control plus three times the standard.

The hMPV antibodies of the IgM and IgA classes were detected in sera by capture EIA essentially as described previously (Rothbarth et al., 1999, J Vir Methods 78:163-169). For the detection of IgA and IgM, commercially available microtiter plates coated with anti human IgM or IgA specific monoclonal antibodies were used. Sera were diluted 1: 100. After incubation of 1 hour at 37° C., an optimal working dilution of hMPV was added to each well (100 μl) before incubation for 1 hour at 37° C. After washing, polyclonal anti-hMPV antibody labeled with peroxidase was added, and the plate was incubated 1 hour at 37° C. Adding TMB as a substrate the plates were developed, and OD was measured at 450 rim. The results were expressed as the S(ignal)/N(egative) ratio of the OD. A positive result was indicated for IgG when the S/N ratio was beyond the negative control plus three times the standard.

AVP antibodies were detected in an AVP inhibition assay. The protocol for the APV inhibition test is included in the APV-Ab SVANOVIR® enzyme immunoassay that is manufactured by SVANOVA Biotech AB, Uppsala Science Park Glunten SE-751 83 Uppsala Sweden. The results were expressed as the S(ignal)/N(egative ratio of the OD. A serum was considered positive for IgG, if the S/N ratio was beyond the negative control plus three times the standard.

7.6 EXAMPLE 14

Detection of Antibodies in Humans, Mammals, Ruminants or Other Animals by Indirect IFA For the detection of virus specific antibodies, infected tMK cells with MPV were fixed with acetone on coverslips (as described above), washed with PBS and incubated 30 minutes at 37° C. with serum samples at a 1 to 16 dilution. After two washes with PBS and one with tap water, the slides were incubated for 30 minutes at 37° C. with FITC-labeled secondary antibodies to the species used (Dako). Slides were processed as described above.

Antibodies can be labeled directly with a fluorescent dye, which will result in a direct immunofluorescence assay. FITC can be replaced with any fluorescent dye.

7.7 EXAMPLE 15

Detection of Antibodies in Humans, Mammals, Ruminants or Other Animals by ELISA In Paramyxoviridae, the N protein is the most abundant protein, and the immune response to this protein occurs early in infection. For these reasons, a recombinant source of the N proteins is preferably used for developing an ELISA assay for detection of antibodies to MPV. Antigens suitable for antibody detection include any MPV protein that combines with any MPV-specific antibody of a patient exposed to or infected with MPV virus. Preferred antigens of the invention include those that predominantly engender the immune response in patients exposed to MPV, thus, typically are recognized most readily by antibodies of a patient. Particularly preferred antigens include the N, F, M and G proteins of MPV. Antigens used for immunological techniques can be native antigens or can be modified versions thereof. Well known techniques of molecular biology can be used to alter the amino acid sequence of a MPV antigen to produce modified versions of the antigen that may be used in immunologic techniques.

Methods for cloning genes, for manipulating the genes to and from expression vectors, and for expressing the protein encoded by the gene in a heterologous host are well-known, and these techniques can be used to provide the expression vectors, host cells, and the for expressing cloned genes encoding antigens in a host to produce recombinant antigens for use in diagnostic assays. See e.g., MOLECULAR CLONING, A LABORATORY MANUAL AND CURRENT PROTOCOLS IN MOLECULAR BIOLOGY.

A variety of expression systems may be used to produce MPV antigens. For instance, a variety of expression vectors suitable to produce proteins in *E. Coli, B. subtilis*, yeast, insect cells, and mammalian cells have been described, any of which might be used to produce a MPV antigen suitable to detect anti-MPV antibodies in exposed patients.

The baculovirus expression system has the advantage of providing necessary processing of proteins, and is therefor preferred. The system utilizes the polyhedrin promoter to direct expression of MPV antigens. (Matsuura et al., 1987, J. Gen. Virol. 68:1233-1250).

Antigens produced by recombinant baculo-viruses can be used in a variety of immunological assays to detect anti-MPV antibodies in a patient. It is well established that recombinant antigens can be used instead of natural virus in practically any immunological assay for detection of virus specific antibodies. The assays include direct and indirect assays, sandwich assays, solid phase assays such as those using plates or beads among others, and liquid phase assays. Assays suitable include those that use primary and secondary antibodies, and those that use antibody binding reagents such as protein A. Moreover, a variety of detection methods can be used in the invention, including calorimetric, fluorescent, phosphorscent, chemiluminescent, luminescent and radioactive methods.

For example, an indirect IgG EIA using a recombinant N protein (produced with recombinant baculo-vuus in insect (Sf9) cells) as antigen can be performed. For antigen preparation, Sf9 cells are infected with the recombinant baculovirus and harvested 3-7 days post infection. The cell suspension is washed twice in PBS, pH 7.2, adjusted to a cell density of $5.0\times10^6$ cells/ml, and freeze-thawed three times. Large cellular debris is pelleted by low speed centrifugation (500×g for 15 minutes) and the supernatant is collected and stored at −70° C. until use. Uninfected cells are processed similarly for negative control antigen.

Once the antigen is prepared, 100 μl of a freeze-thaw lysate is used to coat microtiter plates at dilutions ranging from 1:50 to 1:1000. An uninfected cell lysate is run in duplicate wells and serves as a negative control. After incubation overnight, plates are washed twice with PBS/0.05% Tween. Test sera are diluted 1:50 to 1:200 in ELISA buffer (PBS, supplemented to 2% with nonmal goat sera, and with 0.5% bovine serum albumin and 0.1% milk), followed by incubation wells for 1 hour at 37° C.

Plates are washed two times with PBS/0.05% Tween. Horseradish peroxidase labeled goat anti-human (or against other species) IgG, diluted 1:3000 to 1:5000 in ELISA buffer, is added to wells, and incubated for 1 hour at 37° C. The plates are then washed two times with PBS/0.05% Tween and once with tap water, incubated for 15 minutes at room temperature with the enzyme substrate TMB, 3,3',5,5' tetramethylbenzidine, such as that obtained from Sigma, and the reaction is stopped with 100 μl of 2 M phosphoric acid. Colorimetric readings are measured at 450 nm using an automated microtiter plate reader.

7.8 EXAMPLE 16

Virus Neutralization Assay

When a subject is infected with a virus, an array of antibodies against the virus are produced. Some of these antibodies can bind virus particles and neutralize their infectivity. Virus neutralization assays (VN) are usually conducted by mixing dilutions of serum or monoclonal antibody with virus, incubating them, and assaying for remaining infectivity with cultured cells, embryonated eggs, or animals. Neutralizing antibodies can be used to define type-specific antigens on the virus particle, e.g., neutralizing antibodies could be used to define serotypes of a virus. Additionally, broadly neutralizing antibodies may also exist.

VN assays were performed with serial two-fold dilutions of human and animal sera starting at an eight-fold dilution. Diluted sera were incubated for one hour with 100 $TCID_{50}$ of virus before inoculation of tMK cells grown in 96 well plates, after which the plates were centrifuged at 840×g. The media was changed after three and six days and IFA was conducted with FTIC-labeled ferret antibodies against MPV 8 days after inoculation. The VN titre was defined as the lowest dilution of the serum sample resulting in negative IFA and inhibition of CPE in cell cultures.

7.9 EXAMPLE 17

RNA Isolation

The presence of viruses in a host can also be diagnosed by detecting the viral nucleic acids in samples taken from the host (See e.g., RT-PCR in Example 18 and RAP-PCR in Example 19).

RNA was isolated from the supernatants of infected cell cultures or sucrose gradient fractions using a High Pure RNA Isolation kit, according to instructions from the manufacturer (Roche Diagnostics, Ahnere, The Netherlands). RNA can also be isolated following other procedures known in the art (see, e.g., CURRENT PROTOCOLS IN MOLECULAR BIOLOGY, volume 1-3 (1994-1998). Ed. by Ausubel, F. M. et al., Published by John Wiley and sons, Inc., USA).

7.10 EXAMPLE 18

RT-PCR to Detect/Diagnose MPV

Detection of the virus in a biological sample can be done using methods that copy or amplify the genomic material of the virus. Virus-specific oligonucleotide sequences for RT-PCR assays on known paramyxoviruses are described below in this Example. A one-step RT-PCR was performed in 50 μl reactions containing 50 mM Tris.HCl pH 8.5, 50 mM NaCl, 4 mM $MgCl_2$, 2 mM dithiotreitol, 200 μM each dNTP, 10 units recombinant RNAsin (Promega, Leiden, the Netherlands), 10 units AMV RT (Promega, Leiden, The Netherlands), 5 units Amplitaq Gold DNA polymerase (PE Biosystems, Nieuwerkerk aan de Ijssel, The Netherlands) and 5 µl RNA. Cycling conditions were 45 min. at 42° C. and 7 min. at 95° C. once, 1 min at 95° C., 2 min. at 42° C. and 3 min. at 72° C. repeated 40 times and 10 min. at 72° C. once. Primers sequences are provided in the sequence listing. More specifically, the primers used for the nucleoprotein gene were N3 and N4, having nucleotide sequences corresponding to SEQ ID NOs:28 and 29 respectively, and were used to amplify a 151 nucleotide fragment. The primers used for the matrix protein gene were M3 and M4, having nucleotide sequences corresponding to SEQ ID NOs: 30 and 31 respectively, and were used to amplify a 252 nucleotide fragment. The primers used for the polymerase protein gene were L6 and L7, corresponding to SEQ ID NOs: 34 and 35 respectively, and were used to amplify a 173 nucleotide fragment. The primers used for the F protein gene were F7 and F8, corresponding to SEQ IS NOs: 32 and 33 respectively, and were used to amplify a 221 nucleotide fragment.

Furthermore, probes were used to confirm the presence of hMPV genome sequences. The probe used to detect the M gene had a nucleotide sequence corresponding to SEQ ID NO: 36. The probe used to detect the N gene had a nucleotide sequence corresponding to SEQ ID NO: 37. The probe used to detect the L gene had a nucleotide sequence corresponding to SEQ ID NO:38.

In another example, primers and probes can be designed based on MPV sequences that are known or obtained tlrough sequencing. Likewise, different sequences of primers and difference buffer and assay conditions to be used for specific purposes would be known to one skilled in the art.

RT-PCR was used for the detection of known paramyxoviruses as well. Primers for hPIV-1 to 4, mumps, measles, Tupsia, Mapuera, and Hendra were developed in house and based on alignments of available sequences. Primers for New Castle Disease Virus were taken from Seal, J., J. et al; Clin. Microb., 2624-2630, 1995. Primers for Nipah and general paramyxovirus-PCR were taken from Chua, et al., 2000, Science, 288. The primers used to detect other known paramyxoviruses were as follows: hPIV-1 was detected with primers corresponding to the sequences of SEQ ID NO: 58 and 59 for the forward and reverse primers respectively, hPIV-2 was detected with primers corresponding to the sequences of SEQ ID NO: 60 and 61 for the forward and reverse primers respectively, hPIV-3 was detected with primers corresponding to the sequences of SEQ ID NO: 62 and 63 for the forward and reverse primers respectively, hPIV-4 was detected with primers corresponding to the sequences of SEQ ID NO: 64 and 65 for the forward and reverse primers respectively, Mumps was detected with primers corresponding to the sequences of SEQ ID NO: 66 and 67 for the forward and reverser primers respectively, NDV was detected with primers corresponding to the sequences of SEQ ID NO: 68 and 69 for the forward and reverse primers respectively, Tupaia was detected with primers corresponding to the sequences of SEQ ID NO: 70 and 71 for the forward and reverse primers respectively, Mapuera was detected with primers corresponding to the sequences of SEQ ID NO: 72 and 73 for the forward and reverse primers respectively, Hendra was detected with primers corresponding to the sequences of SEQ ID NO: 74 and 75 for the forward and reverse primers respectively, Nipah was detected with primers corresponding to the sequences of SEQ ID NO: 76 and 77 for the forward and reverse primers respectively, HRSV was detected with primers corresponding to the sequences of SEQ ID NO: 78 and 79 for the forward and reverse primers respectively, Measles was detected with primers corresponding to the sequences of SEQ ID NO: 80 and 81 for the forward and reverse primers respectively, and general Paramyxoviridae viruses were detected with primers corresponding to the sequences of SEQ ID NO: 82 and 83 for the forward and reverse primers respectively.

7.11 EXAMPLE 19

RAP-PCR

The genetic material of MPV or another virus can be detected or amplified using primers that hybridize to regions within the genome and that extend in a particular direction so that the genetic material is amplified. This type of technique is useful when specific sequence information is unavailable or when performing an initial amplification of genetic material in a sample. One such technique is called RAP-PCR.

RAP-PCR was performed essentially as described (Welsh et al., 1992, NAR 20:4965-4970). For the RT reaction, 2 µl of RNA was used in a 10 µl reaction containing 10 ng/µl oligonucleotide, 10 mM dithiotreitol, 500 µm each dNTP, 25 mM Tris-HCl pH 8.3, 75 mM KCl and 3 mM $MgCl_2$. The reaction mixture was incubated for 5 minutes at 70° C. and 5 minutes at 37° C., after which 200 units Superscript RT enzyme (LifeTechnologies) were added. The incubation at 37° C. was continued for 55 minutes and the reaction was terminated by a 5 minute incubation at 72° C. The RT mixture was diluted to give a 50 µl PCR reaction containing 8 ng/µl oligonucleotide, 300 µl each dNTP, 15 mM Tris-HCl pH 8.3,65 mM KCl, 3.0 mM $MgCL_2$ and 5 units Taq DNA polymerase (FE Biosystems). Cycling conditions were 5 minutes at 94° C., 5 minutes at 40° C., and 1 minute at 72° C. once, followed by 1 minute at 94° C., 2 minutes at 56° C. and 1 minute at 72° C. repeated 40 times, and 5 minutes at 72° C. once.

Primers used for RAP-PCR were: primer ZF1 with a nucleotide sequence corresponding to SEQ ID NO: 46, primer ZF4 with a nucleotide sequence corresponding to SEQ ID NO: 47, primer ZF7 with a nucleotide sequence corresponding to SEQ ID NO: 48, primer ZF10 with a nucleotide sequence corresponding to SEQ ID NO: 49, primer ZF13 with a nucleotide sequence corresponding to SEQ ID NO: 50, primer ZF16 with a nucleotide sequence corresponding to SEQ ID NO: 51, primer CS1 with a nucleotide sequence corresponding to SEQ ID NO: 52, CS4 with a nucleotide sequence corresponding to SEQ ID NO: 53, primer CS7 with a nucleotide sequence corresponding to SEQ ID NO: 54, primer CS10 with a nucleotide sequence corresponding to SEQ ID NO: 55, primer CS13 with a nucleotide sequence corresponding to SEQ ID NO: 56, and primer CS16 with a nucleotide sequence corresponding to SEQ ID NO: 57. Products were run side by side on a 3% NuSieve agarose gel (FMC BioProducts, Heerhugowaard, The Netherlands). Differentially displayed fragments specific for MPV were purified from the gel with a Qiaquick Gel Extraction kit (Qiagen, Leusden, The Netherlands) and cloned in pCR2.1 vector (Invitrogen, Groningen, The Netherlands), according to instructions from the manufacturer. Twenty fragments were successfully purified and sequenced. Sequence homology to APV was found in ten fragments, i.e. fragment 1 isolated using the ZF7 primer yielded a 335 bp fragment with homology to the N gene, fragment 2 isolated using the ZF10 primer yielded a 235 bp fragment with homology to the N gene, fragment 3 isolated using the ZF10 primer yielded a 800 bp fragment with homology to the M gene, fragment 4 isolated using the CS1 primer yielded a 1250 bp fragment with homology to the F gene, fragment 5 isolated using the CS10 primer yielded a 400 bp fragment with homology to the F gene, fragment 6 isolated using the CS13 primer yielded a 1450 bp fragment with homology to the F gene, fragment 7 isolated using primer CS13 yielded a 750 bp fragment with homology to the F gene, fragment 8 isolated using the ZF4 primer yielded a 780 bp fragment with homology to the L gene (protein level), fragment 9 isolated using the ZF10 primer yielded a 330 bp fragment with homology to the L gene (protein level), and fragment 10 isolated using the ZF10 primer yielded a 250 bp fragment with homology to the L gene (protein level).

TaqMan assays can be used to measure the level of expression of a gene. TaqMan assays were adapted to examine the expression of the L-gene and the N-gene. The primers that were used in these assays are not required to be specific to any one of the hMPV groups, however, examples are shown below. Reactions were carried out with a 500 nM concentration of a forward primer, 250 nM concentration of a reverse primer, 250 nM concentration of an oligonucleotide probe, 25 μl of a universal PCR mastermix (available from ABI), and 5 μl of cDNA in a 50 μl total reaction volume. Cycling conditions were: a first step of 10 minutes at 95° C., followed by a second step of 45 cycles consisting of 30 seconds at 95° C. and 60 seconds at 60° C. on an ABI 7000 sequence detection system.

Other examples of primers for the N gene of hMPV to be used in TaqMan assays are as follows: For isolates NL/1/00, BI/1/01, FI/4/01, NL/8/01, and FI/2/01, all of the subgroup A1, primers with the nucleotide sequence of SEQ ID NO: 39 could be used. For isolate NL/30/01, of the subgroup A1, a primer with the nucleotide sequence of SEQ ID NO: 40 could be used. For isolates NL/22/01 and NL/23/01, of the subgroup A2, a primer with the nucleotide sequence of SEQ ID NO: 41 could be used. For isolates NL/17/01, of the subgroup A2, a primer with the nucleotide sequence of SEQ ID NO: 42 could be used. For isolate NL/17/00, of the subgroup A2, a primer with the nucleotide sequence of SEQ ID NO: 43 could be used. For isolates NL/1/99, NL/5/01, NL/21/01, and NL/9/01, of the subgroup B1, a primer with the nucleotide sequence of SEQ ID NO: 44. For isolates FI/1/01 and FI/10/01, of subgroup B1, a primer with the nucleotide sequence of SEQ ID NO: 45 could be used.

A potential probe that can be used for the A1 subgroup corresponds to SEQ ID NO:390, a probe that can be used for the B1 subgroup corresponds to SEQ ID NO:391, and a probe that can be used for the B2 subgroup corresponds to SEQ ID NO:392.

7.12 EXAMPLE 20

Sequence Analysis of RAP-PCR Products

After segments are amplified using RAP-PCR, sequence information can be obtained on the amplfied segments. In order to do so, it is advantageous to clone the generated fragments into vectors before sequencing.

RAP-PCR products cloned in vector pCR2.1 (Invitrogen) were sequenced with M13-specific oligonucleotides. DNA fragments obtained by RT-PCR were purified from agarose gels using Qiaquick Gel Extraction kit (Qiagen, Leusden, The Netherlands), and sequenced directly with the same oligonucleotides used for PCR. Sequence analyses were performed using a Dyenamic ET terminator sequencing kit (Amersham Pharmacia Biotech, Roosendaal, The Netherlands) and an ABI 373 automatic DNA sequencer (PE Biosystem). All techniques were performed according to the instructions of the manufacturer.

7.13 EXAMPLE 21

Generating Genomic Fragments by RT-PCR

The RAP-PCR method can leave gaps in the sequence that have not be amplified or copied. In order to obtain a complete sequence, the sequence information of the gaps can be obtained using RT-PCR.

To generate PCR fragments spanning gaps A, B and C between the RAP-PCR fragments (FIG. 3), RT-PCR assays were used as described previously on RNA samples isolated from virus isolate 00-1.

The following primers were used to generate fragment A: TR1 designed in the leader, corresponding to the nucleotide sequence of SEQ ID NO:22 and N1 designed at the 3' end of the RAP-PCR fragments obtained in N and corresponding to the sequence of SEQ ID NO:23. The following primers were used to generate fragment B: N2 designed at the 5' end of the RAP-PCR fragments obtained in N and corresponding to the nucleotide sequence of SEQ ID NO:24 and M1 designed at the 3' end of the RAP-PCR fragments obtained in M and corresponding to the nucleotide sequence of SEQ ID NO:25. The following primers were used to generate fragment C: M2 designed at the 5' end of the RAP-PCR fragment obtained in M and corresponding to the nucleotide sequence of SEQ ID NO:26 and F1 designed at the 3' end of the RAP-PCR fragments obtained in F and corresponding to the nucleotide sequence of SEQ ID NO: 27.

Fragments were purified after gel electrophoresis and cloned and sequenced as described previously.

7.14 EXAMPLE 25

Capture Anti-MPV IgM EIA Using a Recombinant Nucleoprotein

In order to detect the hMPV virus, an immunological assay that detects the presence of the antibodies in a variety of hosts. In one example, antibodies to the N protein are used because it is the most abundant protein that is produced. This feature is due the transciptional gradient that occurs across the genome of the virus.

A capture IgM EIA using the recombinant nucleoprotein or any other recombinant protein as antigen can be performed by modification of assays as previously described by Erdman et al., 1990, J. Clin. Microb. 29: 1466-1471.

Affinity purified anti-human IgM capture antibody (or against other species), such as that obtained from Dako, is added to wells of a microtiter plate in a concentration of 250 ng per well in 0.1 M carbonate buffer pH 9.6. After overnight incubation at room temperature, the plates are washed two times with PBS/0.05% Tween. 100 μl of test serum diluted 1:200 to.1:1000 in ELISA buffer is added to triplicate wells and incubated for 1 hour at 37° C. The plates are then washed two times with in PBS/0.05% Tween.

The freeze-thawed (infected with recombinant virus) Sf21 cell lysate is diluted 1:100 to 1:500 in ELISA buffer is added to the wells and incubated for 2 hours at 37° C. Uninfected cell lysate serves as a negative control and is run in duplicate wells. The plates are then washed three times in PBS/0.05% Tween and incubated for 1 hour at 37° C. with 100 μl of a polyclonal antibody against MPV in a optimal dilution in ELISA buffer. After 2 washes with PBS/0.05% Tween, the plates are incubated with horseradish peroxide labeled secondary antibody (such as rabbit anti ferret), and the plates are incubated 20 minutes at 37° C.

The plates are then washed five times in PBS/0/05% Tween, incubated for 15 minutes at room temperature with the enzyme substrate TMB, 3,3,5,5 tetramethylbenzidine, as, for instance obtained from "Sigma", and the reaction is stopped with 100 μl of 2M phosphoric acid. Colormetric readings are measured at 450 nm using automated microtiter plate reader.

The sensitivities of the capture IgM EIAs using the recombinant nucleoprotein (or other recombinant protein) and whole MPV virus are compared using acute-and convalescent-phase serum pairs form persons with clinical MPV virus infection. The specificity of the recombinant nucleoprotein capture EIA is determined by testing serum specimens from healthy persons and persons with other paramyxovirus infections.

Potential for EIAs for using recombinant MPV fusion and glycoprotein proteins produced by the baculovirus expression.

The glycoproteins G and F are the two transmembraneous envelope glycoproteins of the MPV virion and represent the major neutralisation and protective antigens. The expression of these glycoproteuns in a vector virus system sych as a baculovinus system provides a source of recombinant antigens for use in assays for detection of MPV specific antibodies. Moreover, their use in combination with the nucleoprotein, for instance, further enhances the sensitivity of enzyme immunoassays in the detection of antibodies against MPV.

A variety of other immunological assays (*Current Protocols in Immunology*, volume 1-3. Ed. by Coligan, J. E., Kruisbeek, A. M., Margulies, D. H., Shevach, E. M. and Strobe, W. Published by John Wiley and sons, Inc., USA) may be used as alternative methods to those described here.

In order to find virus isolates nasopharyngeal aspirates, throat and nasal swabs, broncheo alveolar lavages and throat swabs preferable from but not limited to humans, carnivores (dogs, cats, seals etc.), horses, ruminants (cattle, sheep, goats etc.), pigs, rabbits, birds (poultry, ostridges, etc) can be examined. From birds, cloaca and intestinal swabs and droppings can be examined as well. For all samples, serology (antibody and antigen detection etc.), virus isolation and nucleic acid detection techniques can be performed for the detection of virus. Monoclonal antibodies can be generated by immunizing mice (or other animals) with purified MPV or parts thereof (proteins, peptides) and subsequently using established hybridoma technology (*Current Protocols in Immnology*, Published by John Wiley and sons, Inc., USA). Alternatively, phage display technology can be used for this purpose (*Current Protocols in Immunology*, Published by John Wiley and sons, Inc., USA). Similarly, polyclonal antibodies can be obtained from infected humans or animals, or from immunised humans or animals (*Current Protocols in Immunology*, Published by John Wiley and sons, Inc., USA).

The detection of the presence or absence of NS1 and NS2 proteins can be performed using western-blotting, IFA, immuno precipitation techniques using a variety of antibody preparations. The detection of the presence or absence of NS1 and NS2 genes or homologues thereof in virus isolates can be performed using PCR with primer sets designed on the basis of known NS1 and/or NS2 genes as well as with a variety of nucleic acid hybridisation techniques.

To determine whether NS1 and NS2 genes are present at the 3' end of the viral genome, a PCR can be performed with primers specific for this 3' end of the genome. In our case, we used a primer specific for the 3' untranslated region of the viral genome and a primer in the N ORF. Other primers may be designed for the same purpose. The absence of the NS1/NS2 genes is revealed by the length and/or nucleotide sequence of the PCR product. Primers specific for NS1 and/or NS2 genes may be used in combination with primers specific for other parts of the 3' end of the viral genome (such as the untranslated region or N, M or F ORFs) to allow a positive identification of the presence of NS1 or NS2 genes. In addition to PCR, a variety of techniques such as molecular cloning, nucleic acid hybridisation may be used for the same purpose.

8. Cell Culture Systems and Animal Models for MPV and Recombinant Engineering of MPV

8.1 EXAMPLE 22

HMPV Growth in Different Cell Lines

Virus isolates can be cultured in different cell lines in order to examine characteristics of each virus. For example, the infectivity of different virus isolates can be characterized and distinguished on the basis of titer levels measured in culture. Alternatively, cells can be used to propagate or amplify strains of the virus in culture for further analysis.

In one example, tertiary monkey kidney cells were used to amplify hMPV. However, tertiary monkey kidney cells are derived from primary cells which may only be passaged a limited number of times and have been passaged three times in vivo. It was not known which kind of immortalized cell line would support hMPV virus growth to high titers. A number of monkey cell lines such as Vero, LLC-MK2, HEp-2, and lung fibroblast (LF1043) cells, were tested to see whether they could support hMPV virus replication (Table 12). Trypsin used was TPCK-trypsin (Worthington) at a concentration of 0.001 mg/ml. The growth of this virus in fertilized 10 day old chicken eggs was also tested. The infected eggs were incubated for 2 and 3 days at 37° C. prior to AF harvest. Virus titers were determined by plaque assay of infected cell lysates on Vero cells without trypsin, incubated for 10 days at 35° C., and immunostained using the guinea pig hMPV antiserum. The results showed that Vero cells and LLC-MK2 cells were the cell substrates most suitable for hMPV virus replication, resulting in virus stock titers of $10^6$-$10^7$ pfu/ml. These titers were similar to those obtained from tMK cells. The addition of trypsin at a concentration of 0.01 mg/ml did not increase virus titers appreciably (Table 12).

TABLE 12

HMPV VIRUS GROWTH IN DIFFERENT CELL LINES

| Cell Substrate | Trypsin used to grow virus | Virus titers on Vero cells (pfu/ml) |
|---|---|---|
| Vero | yes | $2.1 \times 10^7$ |
|  | no | $1.1 \times 10^7$ |
| LLC-MK2 | yes | $2.3 \times 10^5$ |
| Hep-2 | yes | cells died |
| LF 1043 (HEL) | yes | no virus recovered |
|  | no | no virus recovered |
| tMK | yes | $1.0 \times 10^7$ |
| eggs (10 days) | no | no virus recovered |

In order to study the virus kinetics of hMPV viral growth in Vero cells, a growth curve was performed using an MOI of 0.1 (FIG. 23). Cells and cell supernatants were harvested every 24 hours, and analyzed by plaque assay for quantification of virus titers. The results showed that at day 5, near peak titers of hMPV were observed. The absolute peak titer of 5.4 $\log_{10}$ pfu/ml was achieved on Day 8. The virus titer was very stable up to day 10. A growth curve carried out at the same time with solely the cell supernatants, showed only very low virus titers.

This data demonstrated that hMPV replication, under the conditions used (MOI of 0.1) peaked on day 8 post-infection and that hMPV was largely, a cell-associated RNA virus.

TRANSFECTION OF 293 CELLS: 293 cells (human kidney epithelial cells) were passed in DMEM and supplemented with FCS (10%), L-Glutamine (1: 100) and Pen/Strep (1:100) and split 1:10 every 3-4 days. Care was taken not to let the cells grow to confluency in order to enhance transfectability. Cells were not very adherent; a very brief (2 min. or less) incubation in Trypsin-EDTA was usually sufficient to release them from plastic surfaces. Cells were diluted in culture media immediately after trypsin-treatment.

Cells were split the day before transfection. Cell confluency approximated 50-75% when transfected. Gelatinized plasticware was used to prevent cells from detaching throughout the transfection procedure. Plates or flasks were covered with 0.1% gelatinin (1:20 dilution of 2% stock) for 10 minuted and rinsed one time with PBS once. To achieve the correct cell density; cells were used at a concentration of $1 \times 10^7$ cells per T75 flask or 100 mm plate (in 10 ml) or $1 \times 10^6$ cells per well of a 6-well plate (in 2 ml).

Transfection lasted for a minimum of 7 hours, however, it was preferable to allow the transfection to occur overnight. The following were combined in a sterile tube: 30 mg DNA with 62 ml 2 M $CaCl_2$ and $H_2O$ to 500 ml (T75) or 3 mg DNA with 6.2 ml 2 M $CaCl_2$ and $H_2O$ to 50 ml (6-well plate); with brief mixing. Addition of 500 or 50 ml 2xHBS occurred dropwise and the solutions were allowed to mix for 5 minutes until a precipitate formed. Gentle care was used, i.e. no vortexing was applied. The old media was replaced with fresh prewarmed media (10 ml per T75 flask or 1 ml per well of a 6-well plate. The DNA was mixed carefully by blowing airbubles through the tube with a Gilson pipet and the precipitate was added dropwise to the media covering the cells. The cells were incubated in a 37° C. $CO_2$ atmosphere.

The cells appeared to be covered with little specks (the precipitate). The transfection media was removed from the cells, and the cells were rinsed carefully with PBS, and then replaced with fresh media.

The cells were incubated in a 37° C. $CO_2$ atmosphere until needed, usually between 8-24 hours.

A 10× stock of HBS was prepared with with 8.18% NaCl, 5.94% Hepes and 0.2% $Na_2HPO_4$ (all w/v). The solution was filter sterilized and stored at 4° C. A 2× solution was prepared by diluting the 10× stock with $H_2O$ and adjusting the pH to 7.12 with 1 M NaOH. The solution was stored in aliquots at −20° C. Care was taken to exactly titrate the pH of the solution. The pH was adjusted immediately before the solution was used for the transfection procedure.

8.2 EXAMPLE 23

Minireplicon Construct of MPV

Minireplicon constructs can be generated to contain an antisense reporter gene. An example of a minireplicon, CAT-hMPV, is shown in FIG. 24. The leader and trailer sequences that were used for the generation of the minireplicon construct are shown in FIG. 26. For comparison, an alignment of APV, RSV and PIV3 leader and trailer sequences are also shown in FIG. 26.

Two versions of the minireplicon constructs were tested: one with terminal AC residues at the leader end (Le+AC), and one without terminal AC residues at the leader end (Le−AC). The two constructs were both functional in the assay (FIG. 25). It can be seen in FIG. 25 that much higher CAT expression occurred after 48 hours than after 24 hours. After 48 hours, around 14 ng CAT per 500,000 cells transfected was observed. This experiment was entirely plasmid driven: the minireplicon was cotransfected with a T7 polymerase plasmid, and the N, P, L, M2.1 genes were expressed from pCITE-2a/3a (the pCite plasmids have a T7 promoter followed by the IRES element derived from the encephalomyocarditis virus (EMCV)). The CAT expression was completely abolished when L, P and N were excluded. A significant reduction in CAT expression was noted when M2.1 expression was excluded from the vector.

The specificity (attributes to heterologous viruses) and the effect of the terminal residues of the leader (attributes to homologous virus) of the minireplicon system can also be tested by superinfecting the minireplicon-transfected cells with hMPV polymerase components (NL/1/00 and NL/1/99) or polymerase components from APV-A, APV-C, RSV or PIV. The different amount of each of the six plasmids can also be tested in order to determine the optimal conditions.

Other reporter genes can be used instead of CAT. In other examples, GFP can be inserted into the minireplicon construct instead of CAT.

8.3 EXAMPLE 24

Generation of Full Length Infectious cDNA

Full length cDNAs that express the genes of the hMPV virus can be constructed so that infectious viruses can be produced. For example, a cDNA encoding all of the genes or all of the essential genes of hMPV can be constructed; the genome can then be expressed to produce infectious viruses.

In order to genetically manipulate hMPV, the genome of this RNA virus was cloned. For the 00-1 isolate of hMPV, eight PCR fragments varying in length from 1-3 kb were generated (FIG. 27). The PCR fragments were sequenced and analyzed for sequence errors by comparison to the hMPV sequence deposited in Genbank. Two silent mutations (nucleotide 5780 ile:ile in the SH gene, nucleotide 12219 cys:cys in the L gene) were not corrected. Another change in the L gene at nucleotide 8352 (trp:leu) was not changed since this mutation was observed in two independently generated PCR fragments (C and H), as well as in the hMPV 99-1 sequence. Similarly, a 5 nucleotide insertion at nucleotide 4715 in the F-M2 intergenic region was not corrected. Both of these changes may be reflected in the wild type sequence of hMPV. In contrast, at nucleotide 1242, a single A residue was removed in the N-P intergenic region; at nucleotide 3367, a ser:pro was corrected in the F gene; at nucleotide 6296, an asp:val was changed in the G gene; and at nucleotide 7332 a stop codon was changed to a glu in the L gene. Restriction maps of different isolates of hMPV are shown in FIG. 28. The restriction sites can be used to assemble the full-length construct.

The eight corrected PCR fragments were then assembled in sequence, taking advantage of unique restriction enzyme sites (FIG. 29). A genetic marker was introduced at nucleotide 75 generating an AflII restriction enzyme site without altering the amino acid sequence. A unique restriction enzyme site, XhoI, was added at the 3' end of the hMPV sequence. A phage T7 polymerase promoter followed by two G residues was also added to the 3' end of the hMPV sequence. At the 5' end of the hMPV genome, a Hepatitis delta ribozyme sequence and BssHII restriction enzyme site were added.

Helper plasmids encoding the hMPV L, N, P and M2-1 gene in a pCITE plasmid were also generated. Once the full-length hMPV cDNA was generated, virus recovery by reverse genetics was performed in Vero cells using fowl-pox T7 or MVA-T7 as a source of T7 polymerase.

8.4 EXAMPLE 26

Infection of Animal Hosts with Subtypes of hMPV

Animal hosts can be infected in order to characterize the virulence of MPV strains. For example, different hosts can be used in order to determine how infectious each strain is in an organism.

A small animal model for hMPV had not been identified. Balb/c mice, cotton rats, and Syrian Golden hamsters were infected with hMPV using a dose of $1.3 \times 10^6$ pfu/animal. The animals were inoculated intranasally with $1.3 \times 10^6$ pfu of hMPV in a 0.1 ml volume. The tissue samples were quantified by plaque assays that were immunostained on Day 9 with the hMPV guinea pig antiserum. Four days post-infection, the animals were sacrificed, and the nasal turbinates and lungs were isolated and quantified for hMPV titers by plaque assays that were immunostained (Table 13).

TABLE 13

HMPV TITERS IN INFECTED ANIMALS

| Animals | Number of animals | Mean virus titer on day 4 post-infection ($\log_{10}$ PFU/g tissue +/− Standard Error) | |
|---|---|---|---|
| | | Nasal turbinates | Lungs |
| mice (Balb c) | 6 | 2.7 +/− 0.4 | 2.2 +/− 0.6 |
| cotton rats | 5 | <1.7 +/− 0.0 | <1.8 +/− 0.0 |
| Syrian Golden hamsters | 6 | 5.3 +/− 0.2 | 2.3 +/− 0.6 |

The results showed that hMPV replicated to high titers in Syrian Golden hamsters. Titers of 5.3 and 2.3 log10 pfu/g tissue were obtained in the nasal turbinates and lungs, respectively. hMPV did not replicate to any appreciable titer levels in the respiratory tracts of cotton rats. Mice showed titers of 2.7 and 2.2 $\log_{10}$ pfu/g tissue in the upper and lower respiratory tracts, respectively. These results suggested that Syrian Golden hamsters would be a suitable small animal model to study hMPV replication and immunogenicity as well as to evaluate hMPV vaccine candidates.

INFECTION OF GUINEA PIGS. Two virus isolates, 00-1 (subtype A) and 99-1 (subtype B), were used to inoculate six guinea pigs per subtype (intratracheal, nose and eyes). Six guinea pigs were infected with hMPV 00-1 (10e6,5 TCID50). Six guinea pigs were infected with hMPV 99-1 (10e4,1 TCID50). The primary infection was allowed to progress for fifty-four days when the guinea pigs were inoculated with the homologous and heterologous subtypes (10e4 TCID50/ml), i.e., two guinea pigs had a primary infection with 00-1 and a secondary infection with 99-1 in order to achieve a heterologous infection, three guinea pigs had a primary infection with 00-1 and a secondary infection with 00-1 to achieve a homologous infection, two guinea pigs had a primary infection with 99-1 and a secondary infection with 00-1 to achieve a heterologous infection and three guinea pigs had a primary infection with 99-1 and a secondary infection with 99-1 to achieve a homologous infection.

Throat and nose swabs were collected for 12 days (primary infection) or 8 days (secondary infection) post infection, and were tested for the presence of the virus by RT-PCR assays. The results (FIG. 32) of the RT-PCR assays showed that guinea pigs inoculated with virus isolate 00-1 showed infection of the upper respiratory tract on days 1 through 10 post infection. Guinea pigs inoculated with 99-1 showed infection of the upper respiratory tract day 1 to 5 post infection. Infection of guinea pigs with 99-1 appeared to be less severe than infection with 00-1. A second inoculation of the guinea pigs with the heterologous virus, as commented on above, resulted in re-infection in 3 out of 4 of the guinea pigs. Likewise, reinfection in the case of the homologous virus occurred in 2 out of 6 guinea pigs. Little or no clinical symptoms were noted in those animals that became re-infected, and no clinical symptoms were seen in those animals that were protected against the re-infections, demonstrating that even with the wild-type virus, a protective effect due to the first infection may have occurred. This also showed that heterologous and homologous isolates could be used as a vaccine.

Both subtypes of hMPV were able to infect guinea pigs, although infection with subtype B (99-1) seemed less severe, i.e., the presence of the virus in nose and throat was for a shorter period than infection with subtype A (00-1). This may have been due to the higher dose given for subtype A, or to the lower virulence of subtype B. Although the presence of pre-existing immunity did not completely protect against re-infection with both the homologous and heterologous virus, the infection appeared to be less prominent, in that a shorter period of presence of virus was noted and not all animals became virus positive.

The serology of guinea pigs that were infected with both subtypes of hMPV was examined. At days 0, 52, 70, 80, 90, 110, 126 and 160, sera were collected from the guinea pigs and tested at a 1:100 dilution in a whole virus ELISA against 00-1 and 99-1 antigens. (See FIG. 33A and B showing the IgG response against 00-1 and 99-1 for each individual guinea pig. See also FIG. 34 showing the specificity of the 00-1 and 99-1 ELISA but note that only data from homologous reinfected guinea pigs was used. See also FIG. 35 showing the mean IgG response against 00-1 and 99-1 ELISA of three homologous, i.e. 00-1 and 00-1, two homologous, i.e., 99-1 and 99-1, two heterologous, i.e., 99-1 and 00-1, and 2 heterologous, i.e., 00-1 and 99-1 infected guinea pigs).

Only a minor difference in response to the two different ELISAs was observed. Whole virus ELISA against 00-1 or 99-1 could not be used to discriminate between the two subtypes.

The reactivity of sera raised against hMPV in guinea pigs with APV antigen was examined. Sera were collected from the infected guinea pigs and tested with an APV inhibition ELISA. (See FIG. 36, showing the mean percentage of APV inhibition of hMPV infected guinea pigs). Sera raised against hMPV in guinea pigs reacted in the APV inhibition test in a manner similar to their reaction in the hMPV IgG ELISA's. Sera raised against 99-1 revealed a lower percentage of inhibition in the APV inhibition ELISA than sera raised against 00-1. Guinea pigs infected with 99-1 may have had a lower titer than that seen in the hMVP ELISAs. Alternatively, the cross-reaction of 99-1 with APV could have been less than that of 00-1. Nevertheless, the APVAb inhibition ELISA could be used to detect hMPV antibodies in guinea pigs.

Virus neutralization assays were performed with sera raised against hMPV in guinea pigs. Sera were collected at day 0, day 52, day 70 and day 80 post infection and used in a virus cross-neutralization assay with 00-1, 99-1, and APV-C. The starting dilution used was 1 to 10 and 100 TCID50 virus per well. After neutralization, the virus was exposed to tMK cells (15 mm.) and centrifuged at 3500 RPM, after which the media was refreshed. The APV cultures were grown for 4 days and the hMPV cultures were grown for 7 days. Cells were fixed with 80% acetone, and IFAs were conducted with labeled monkey-anti hMPV. Wells that were negative upon staining were defined as the neutralizing titer. For each virus, a 10-log titration of the virus stock and a 2 fold titration of the working solution was included. (See FIG. 37 showing the virus neutralization titers of 00-01 and 99-1 infected guinea pigs against 00-1, 99-1, and APV-C).

INFECTION OF CYNOMOLOGOUS MACAGUES. Virus isolates 00-1 (subtype A) and 99-1 (subtype B) (1e5 TCID50) was used to inoculate two cynomologous macaques per subtype (intratracheal, nose and eyes). Six months after the primary infection, the macaques were inoculated for the second time with 00-1. Throat swabs were collected for 14 days (primary infection) or 8 days (secondary infection) post infection, and were tested for presence of the virus by RT-PCR assays (FIG. 38).

Cynomologous macaques inoculated with virus isolate 00-1 showed infection of the upper respiratory tract day 1 to 10 post infection. Clinical symptoms included a suppurative rhinitis. A second inoculation of the macaques with the homologous virus results in re-infection, as demonstrated by PCR, however, no clinical symptoms were seen.

Sera were collected from the macaques that received 00-1 during six months after the primary infection (re-infection occurred at day 240 for monkey 3 and day 239 for monkey 6). Sera were used to test for the presence of IgG (FIG. 39B) antibodies against either 00-1 or APV, and for the presence of IgA and IgM antibodies against 00-1 (FIG. 39A).

Two macaques were succesfully infected with 00-1 and in the presence of antibodies against 00-1 were reinfected with the homologous virus. The response to IgA and IgM antibodies showed the raise in IgM antibodies after the first infection, and the absence of it after the reinfection. IgA antibodies were only detected after the re-infection, showing the immediacy of the immune response after a first infection. Sera raised against hMPV in macaques that were tested in an APV inhibition ELISA showed a similar response as to the hMPV IgG ELISA.

Antibodies to hMPV in cynomologous macaques were detected with the APV inhibition ELISA using a similar sensitivity as that with the hMPV ELISA, and therefore the APV inhibition EIA was suitable for testing human samples for the presence of hMPV antibodies.

Virus cross-neutralization assays were preformed on sera collected from hMPV infected cynomologous macaques. The sera were taken from day 0 to day 229 post primary infection and showed only low virus neutralization titers against 00-1 (0-80), the sera taken after the secondary infection showed high neutralisation titers against 00-1, i.e., greater than 1280. Only sera taken after the secondary infection showed neutralization titers against 99-1 (80-640), and none of the sera were able to neutralize the APV C virus, There was no cross reaction between APV-C and hMPV in virus cross-neutralization assays, however, there was a cross reaction between 00-1 and 99-1 after a boost of the antibody response.

INFECTION OF HUMANS. The sera of patients ranging in ages under six months or greater than twenty years of age were previously tested using IFA and virus neutralization assays against 00-1. These sera were tested for the presence of IgG, IgM and IgA antibodies in an ELISA against 00-1. The samples were also tested for their ability to in inhibit the APV ELISA. A comparison of the use of the hMPV ELISA and the APV inhibition ELISA for the detection of IgG antibodies in human sera was made and a strong correlation between the IgG hMPV test and the APV-Ab test was noted, therefore the APV-Ab test was essentially able to detect IgG antibodies to hMPV in humans (FIG. 40).

INFECTION OF POULTRY. The APV inhibition ELISA and the 00-1 ELISA were used to test chickens for the presence of IgG antibodies against APV. Both the hMPV ELISA and the APV inhibition ELISA detected antibodies against APV.

8.5 EXAMPLE 27

APV as a Vaccine in Humans

APV can be used as a vaccine in humans to prevent infection by a human MPV, or to reduce the infectivity of human MPV in human hosts. The vaccine can be a whole APV or a chimeric or recombinant version or derivative thereof, that is comprised of heterologous sequences of another *metapnuemovirus* in addition to sequences of APV. The genome of APV can be used as a backbone to create a recombinant virus vaccine. For example, a vaccine can be made where the F-gene and/or the G-gene of APV is substituted by the F-gene or the G-gene of human MPV. Alternatively, a vaccine can be made that includes sequences from PIV substituted for or added to sequences of an APV backbone. For more on the construction of a recombinant/chimeric vaccine, see, e.g., Construction of the Recombinant cDNA and RNA.

The vaccine can be administered to a candidate by a variety of methods known to those skilled in the art, (see, Section 5.13, infra) including but not limited to, subcutaneous injection, intranasal administration, or inhalation. The viruses and/or vaccines of the invention are administered at a starting dosage of at least between $10^3$ TCID$_{50}$ and $10^6$ TCID$_{50}$. The viruses and/or vaccines are administered in either single or multiple dosages, e.g., a primary dose can be administered with one or more subsequent or booster doses administered at periodic time intervals throughout the host life. In a clinical trial, the replication rate of the virus can be used as an index to adjust the dosage of the vaccine so that an effective dosage regimen can be determined. A comparison can be made between the replication rate of the virus in the study population and a predetermined rate that is known to be effective.

The present invention is not to be limited in scope by the specific described embodiments that are intended as single illustrations of individual aspects of the invention, and any constructs, viruses or enzymes that are functionally equivalent are within the scope of this invention. Indeed, various modifications of the invention in addition to those shown and described herein will become apparent to those skilled in the art from the foregoing description and accompanying drawings. Such modifications are intended to fall within the scope of the appended claims.

8.6 EXAMPLE 28

MPV as a Vaccine in Birds

Human MPV can be used as a vaccine in birds to prevent infection by an APV, or to reduce the infectivity of APV in avian hosts. The vaccine can be a whole MPV or a chimeric or recombinant version or derivative thereof, that is comprised of heterologous sequences of another *metapnuemovirus in* addition to sequences of MPV. The genome of human MPV can be used as a backbone to create a recombinant virus vaccine. For example, a vaccine can be made where the F-gene and/or the G-gene of human MPV is substituted by the F-gene or the G-gene of APV. For more on the construction of a recombinant/chimeric vaccine, see, e.g., Construction of the Recombinant cDNA and RNA.

The vaccine can be administered to a candidate by a variety of methods, including but not limited to, subcutaneous injection, intranasal administration, or inhalation. The viruses and/or vaccines of the invention are administered at a starting dosage of at least between $10^3$ TCID$_{50}$ and $10^6$ TCID$_{50}$. The viruses and/or vaccines are administered in either single or multiple dosages, e.g., a primary dose can be administered with one or more subsequent or booster doses administered at periodic time intervals throughout the host life. In a clinical trial, the replication rate of the virus can be used as an index to adjust the dosage of the vaccine so that an effective dosage regimen can be determined. A comparison can be made between the replication rate of the virus in the study population and a predetermined rate that is known to be effective.

Various publications are cited herein, the disclosures of which are incorporated by reference in their entireties.

TABLE 14

LEGEND FOR SEQUENCE LISTING

| SEQ ID | Description |
|---|---|
| SEQ ID NO:1 | Human metapneumovirus isolate 00-1 matrix protein (M) and fusion protein (F) genes |
| SEQ ID NO:2 | Avian pneumovirus fusion protein gene, partial cds |
| SEQ ID NO:3 | Avian pneumovirus isolate 1b fusion protein mRNA, complete cds |
| SEQ ID NO:4 | Turkey rhinotracheitis virus gene for fusion protein (F1 and F2 subunits), complete cds |
| SEQ ID NO:5 | Avian pneumovirus matrix protein (M) gene, partial cds and Avian pneumovirus fusion glycoprotein (F) gene, complete cds |
| SEQ ID NO:6 | paramyxovirus F protein hRSV B |
| SEQ ID NO:7 | paramyxovirus F protein hRSV A2 |
| SEQ ID NO:8 | human metapneumovirus 01-71 (partial sequence) |
| SEQ ID NO:9 | Human metapneumovirus isolate 00-1 matrix protein (M) and fusion protein (F) genes |
| SEQ ID NO:10 | Avian pneumovirus fusion protein gene, partial cds |
| SEQ ID NO:11 | Avian pneumovirus isolate 1b fusion protein mRNA, complete cds |
| SEQ ID NO:12 | Turkey rhinotracheitis virus gene for fusion protein (F1 and F2 subunits), complete cds |
| SEQ ID NO:13 | Avian pneumovirus fusion glycoprotein (F) gene, complete cds |
| SEQ ID NO:14 | Turkey rhinotracheitis virus (strain CVL14/1) attachment protien (G) mRNA, complete cds |
| SEQ ID NO:15 | Turkey rhinotracheitis virus (strain 6574) attachment protein (G), complete cds |
| SEQ ID NO:16 | Turkey rhinotracheitis virus (strain CVL14/1) attachment protein (G) mRNA, complete cds |
| SEQ ID NO:17 | Turkey rhinotracheitis virus (strain 6574) attachment protein (G), complete cds |
| SEQ ID NO:18 | isolate NL/1/99 (99-1) HMPV (Human Metapneumovirus) cDNA sequence |
| SEQ ID NO:19 | isolate NL/1/00 (00-1) HMPV cDNA sequence |
| SEQ ID NO:20 | isolate NL/17/00 HMPV cDNA sequence |
| SEQ ID NO:21 | isolate NL/1/94 HMPV cDNA sequence |
| SEQ ID NO:22 | RT-PCR primer TR1 |
| SEQ ID NO:23 | RT-PCR primer N1 |
| SEQ ID NO:24 | RT-PCR primer N2 |
| SEQ ID NO:25 | RT-PCR primer M1 |
| SEQ ID NO:26 | RT-PCR primer M2 |
| SEQ ID NO:27 | RT-PCR primer F1 |
| SEQ ID NO:28 | RT-PCR primer N3 |
| SEQ ID NO:29 | RT-PCR primer N4 |
| SEQ ID NO:30 | RT-PCR primer M3 |
| SEQ ID NO:31 | RT-PCR primer M4 |

TABLE 14-continued

LEGEND FOR SEQUENCE LISTING

| SEQ ID | Description |
|---|---|
| SEQ ID NO:32 | RT-PCR primer F7 |
| SEQ ID NO:33 | RT-PCR primer F8 |
| SEQ ID NO:34 | RT-PCR primer L6 |
| SEQ ID NO:35 | RT-PCR primer L7 |
| SEQ ID NO:36 | Oligonucleotide probe M |
| SEQ ID NO:37 | Oligonucleotide probe N |
| SEQ ID NO:38 | Oligonucleotide probe L |
| SEQ ID NO:39 | TaqMan primer and probe sequences for isolates NL/1/00, BI/1/01, FI/4/01, NL/8/01, FI/2/01 |
| SEQ ID NO:40 | TaqMan primer and probe sequences for isolates NL/30/01 |
| SEQ ID NO:41 | TaqMan primer and probe sequences for isolates NL/22/01 and NL/23/01 |
| SEQ ID NO:42 | TaqMan primer and probe sequences for isolate NL/17/01 |
| SEQ ID NO:43 | TaqMan primer and probe sequences for isolate NL/17/00 |
| SEQ ID NO:44 | TaqMan primer and probe sequences for isolates NL/9/01, NL/21/01, and NL/5/01 |
| SEQ ID NO:45 | TaqMan primer and probe sequences for isolates FI/1/01 and FI/10/01 |
| SEQ ID NO:46 | Primer ZF1 |
| SEQ ID NO:47 | Primer ZF4 |
| SEQ ID NO:48 | Primer ZF7 |
| SEQ ID NO:49 | Primer ZF10 |
| SEQ ID NO:50 | Primer ZF13 |
| SEQ ID NO:51 | Primer ZF16 |
| SEQ ID NO:52 | Primer CS1 |
| SEQ ID NO:53 | Primer CS4 |
| SEQ ID NO:54 | Primer CS7 |
| SEQ ID NO:55 | Primer CS10 |
| SEQ ID NO:56 | Primer CS13 |
| SEQ ID NO:57 | Primer CS16 |
| SEQ ID NO:58 | Forward primer for amplification of HPIV-1 |
| SEQ ID NO:59 | Reverse primer for amplification of HPIV-1 |
| SEQ ID NO:60 | Forward primer for amplification of HPIV-2 |
| SEQ ID NO:61 | Reverse primer for amplification of HPIV-2 |
| SEQ ID NO:62 | Forward primer for amplification of HPIV-3 |
| SEQ ID NO:63 | Reverse primer for amplification of HPIV-3 |
| SEQ ID NO:64 | Forward primer for amplification of HPIV-4 |
| SEQ ID NO:65 | Reverse primer for amplification of HPIV-4 |
| SEQ ID NO:66 | Forward primer for amplification of Mumps |
| SEQ ID NO:67 | Reverse primer for amplification of Mumps |
| SEQ ID NO:68 | Forward primer for amplification of NDV |
| SEQ ID NO:69 | Reverse primer for amplification of NDV |
| SEQ ID NO:70 | Forward primer for amplification of Tupaia |
| SEQ ID NO:71 | Reverse primer for amplification of Tupaia |
| SEQ ID NO:72 | Forward primer for amplification of Mapuera |
| SEQ ID NO:73 | Reverse primer for amplification of Mapuera |
| SEQ ID NO:74 | Forward primer for amplification of Hendra |
| SEQ ID NO:75 | Reverse primer for amplification of Hendra |
| SEQ ID NO:76 | Forward primer for amplification of Nipah |
| SEQ ID NO:77 | Reverse primer for amplification of Nipah |
| SEQ ID NO:78 | Forward primer for amplification of HRSV |
| SEQ ID NO:79 | Reverse primer for amplification of HRSV |
| SEQ ID NO:80 | Forward primer for amplification of Measles |
| SEQ ID NO:81 | Reverse primer for amplification of Measles |
| SEQ ID NO:82 | Forward primer to amplify general paramyxoviridae viruses |
| SEQ ID NO:83 | Reverse primer to amplify general paramyxoviridae viruses |
| SEQ ID NO:84 | G-gene coding sequence for isolate NL/1/00 (A1) |
| SEQ ID NO:85 | G-gene coding sequence for isolate BR/2/01 (A1) |
| SEQ ID NO:86 | G-gene coding sequence for isolate FL/4/01 (A1) |
| SEQ ID NO:87 | G-gene coding sequence for isolate FL/3/01 (A1) |
| SEQ ID NO:88 | G-gene coding sequence for isolate FL/8/01 (A1) |
| SEQ ID NO:89 | G-gene coding sequence for isolate FL/10/01 (A1) |
| SEQ ID NO:90 | G-gene coding sequence for isolate NL/10/01 (A1) |
| SEQ ID NO:91 | G-gene coding sequence for isolate NL/2/02 (A1) |
| SEQ ID NO:92 | G-gene coding sequence for isolate NL/17/00 (A2) |
| SEQ ID NO:93 | G-gene coding sequence for isolate NL/1/81 (A2) |
| SEQ ID NO:94 | G-gene coding sequence for isolate NL/1/93 (A2) |
| SEQ ID NO:95 | G-gene coding sequence for isolate NL/2/93 (A2) |
| SEQ ID NO:96 | G-gene coding sequence for isolate NL/3/93 (A2) |
| SEQ ID NO:97 | G-gene coding sequence for isolate NL/1/95 (A2) |
| SEQ ID NO:98 | G-gene coding sequence for isolate NL/2/96 (A2) |
| SEQ ID NO:99 | G-gene coding sequence for isolate NL/3/96 (A2) |

TABLE 14-continued

LEGEND FOR SEQUENCE LISTING

| | |
|---|---|
| SEQ ID NO:100 | G-gene coding sequence for isolate NL/22/01 (A2) |
| SEQ ID NO:101 | G-gene coding sequence for isolate NL/24/01 (A2) |
| SEQ ID NO:102 | G-gene coding sequence for isolate NL/23/01 (A2) |
| SEQ ID NO:103 | G-gene coding sequence for isolate NL/29/01 (A2) |
| SEQ ID NO:104 | G-gene coding sequence for isolate NL/3/02 (A2) |
| SEQ ID NO:105 | G-gene coding sequence for isolate NL/1/99 (B1) |
| SEQ ID NO:106 | G-gene coding sequence for isolate NL/11/00 (B1) |
| SEQ ID NO:107 | G-gene coding sequence for isolate NL/12/00 (B1) |
| SEQ ID NO:108 | G-gene coding sequence for isolate NL/5/01 (B1) |
| SEQ ID NO:109 | G-gene coding sequence for isolate NL/9/01 (B1) |
| SEQ ID NO:110 | G-gene coding sequence for isolate NL/21/01 (B1) |
| SEQ ID NO:111 | G-gene coding sequence for isolate NL/1/94 (B2) |
| SEQ ID NO:112 | G-gene coding sequence for isolate NL/1/82 (B2) |
| SEQ ID NO:113 | G-gene coding sequence for isolate NL/1/96 (B2) |
| SEQ ID NO:114 | G-gene coding sequence for isolate NL/6/97 (B2) |
| SEQ ID NO:115 | G-gene coding sequence for isolate NL/9/00 (B2) |
| SEQ ID NO:116 | G-gene coding sequence for isolate NL/3/01 (B2) |
| SEQ ID NO:117 | G-gene coding sequence for isolate NL/4/01 (B2) |
| SEQ ID NO:118 | G-gene coding sequence for isolate UK/5/01 (B2) |
| SEQ ID NO:119 | G-protein sequence for isolate NL/1/00 (A1) |
| SEQ ID NO:120 | G-protein sequence for isolate BR/2/01 (A1) |
| SEQ ID NO:121 | G-protein sequence for isolate NL/4/01 (A1) |
| SEQ ID NO:122 | G-protein sequence for isolate FL/3/01 (A1) |
| SEQ ID NO:123 | G-protein sequence for isolate FL/8/01 (A1) |
| SEQ ID NO:124 | G-protein sequence for isolate FL/10/01 (A1) |
| SEQ ID NO:125 | G-protein sequence for isolate NL/10/01 (A1) |
| SEQ ID NO:126 | G-protein sequence for isolate NL/2/02 (A1) |
| SEQ ID NO:127 | G-protein sequence for isolate NL/17/00 (A2) |
| SEQ ID NO:128 | G-protein sequence for isolate NL/1/81 (A2) |
| SEQ ID NO:129 | G-protein sequence for isolate NL/1/93 (A2) |
| SEQ ID NO:130 | G-protein sequence for isolate NL/2/93 (A2) |
| SEQ ID NO:131 | G-protein sequence for isolate NL/3/93 (A2) |
| SEQ ID NO:132 | G-protein sequence for isolate NL/1/95 (A2) |
| SEQ ID NO:133 | G-protein sequence for isolate NL/2/96 (A2) |
| SEQ ID NO:134 | G-protein sequence for isolate NL/3/96 (A2) |
| SEQ ID NO:135 | G-protein sequence for isolate NL/22/01 (A2) |
| SEQ ID NO:136 | G-protein sequence for isolate NL/24/01 (A2) |
| SEQ ID NO:137 | G-protein sequence for isolate NL/23/01 (A2) |
| SEQ ID NO:138 | G-protein sequence for isolate NL/29/01 (A2) |
| SEQ ID NO:139 | G-protein sequence for isolate NL/3/02 (A2) |
| SEQ ID NO:140 | G-protein sequence for isolate NL/1/99 (B1) |
| SEQ ID NO:141 | G-protein sequence for isolate NL/11/00 (B1) |
| SEQ ID NO:142 | G-protein sequence for isolate NL/12/00 (B1) |
| SEQ ID NO:143 | G-protein sequence for isolate NL/5/01 (B1) |
| SEQ ID NO:144 | G-protein sequence for isolate NL/9/01 (B1) |
| SEQ ID NO:145 | G-protein sequence for isolate NL/21/01 (B1) |
| SEQ ID NO:146 | G-protein sequence for isolate NL/1/94 (B2) |
| SEQ ID NO:147 | G-protein sequence for isolate NL/1/82 (B2) |
| SEQ ID NO:148 | G-protein sequence for isolate NL/1/96 (B2) |
| SEQ ID NO:149 | G-protein sequence for isolate NL/6/97 (B2) |
| SEQ ID NO:150 | G-protein sequence for isolate NL/9/00 (B2) |
| SEQ ID NO:151 | G-protein sequence for isolate NL/3/01 (B2) |
| SEQ ID NO:152 | G-protein sequence for isolate NL/4/01 (B2) |
| SEQ ID NO:153 | G-protein sequence for isolate NL/5/01 (B2) |
| SEQ ID NO:154 | F-gene coding sequence for isolate NL/1/00 |
| SEQ ID NO:155 | F-gene coding sequence for isolate UK/1/00 |
| SEQ ID NO:156 | F-gene coding sequence for isolate NL/2/00 |
| SEQ ID NO:157 | F-gene coding sequence for isolate NL/13/00 |
| SEQ ID NO:158 | F-gene coding sequence for isolate NL/14/00 |
| SEQ ID NO:159 | F-gene coding sequence for isolate FL/3/01 |
| SEQ ID NO:160 | F-gene coding sequence for isolate FL/4/01 |
| SEQ ID NO:161 | F-gene coding sequence for isolate FL/8/01 |
| SEQ ID NO:162 | F-gene coding sequence for isolate UK/1/01 |
| SEQ ID NO:163 | F-gene coding sequence for isolate UK/7/01 |
| SEQ ID NO:164 | F-gene coding sequence for isolate FL/10/01 |
| SEQ ID NO:165 | F-gene coding sequence for isolate NL/6/01 |
| SEQ ID NO:166 | F-gene coding sequence for isolate NL/8/01 |
| SEQ ID NO:167 | F-gene coding sequence for isolate NL/10/01 |
| SEQ ID NO:168 | F-gene coding sequence for isolate NL/14/01 |
| SEQ ID NO:169 | F-gene coding sequence for isolate NL/20/01 |
| SEQ ID NO:170 | F-gene coding sequence for isolate NL/25/01 |
| SEQ ID NO:171 | F-gene coding sequence for isolate NL/26/01 |
| SEQ ID NO:172 | F-gene coding sequence for isolate NL/28/01 |
| SEQ ID NO:173 | F-gene coding sequence for isolate NL/30/01 |
| SEQ ID NO:174 | F-gene coding sequence for isolate BR/2/01 |
| SEQ ID NO:175 | F-gene coding sequence for isolate BR/3/01 |
| SEQ ID NO:176 | F-gene coding sequence for isolate NL/2/02 |
| SEQ ID NO:177 | F-gene coding sequence for isolate NL/4/02 |
| SEQ ID NO:178 | F-gene coding sequence for isolate NL/5/02 |
| SEQ ID NO:179 | F-gene coding sequence for isolate NL/6/02 |
| SEQ ID NO:180 | F-gene coding sequence for isolate NL/7/02 |
| SEQ ID NO:181 | F-gene coding sequence for isolate NL/9/02 |
| SEQ ID NO:182 | F-gene coding sequence for isolate FL/1/02 |
| SEQ ID NO:183 | F-gene coding sequence for isolate NL/1/81 |
| SEQ ID NO:184 | F-gene coding sequence for isolate NL/1/93 |
| SEQ ID NO:185 | F-gene coding sequence for isolate NL/2/93 |
| SEQ ID NO:186 | F-gene coding sequence for isolate NL/4/93 |
| SEQ ID NO:187 | F-gene coding sequence for isolate NL/1/95 |
| SEQ ID NO:188 | F-gene coding sequence for isolate NL/2/96 |
| SEQ ID NO:189 | F-gene coding sequence for isolate NL/3/96 |
| SEQ ID NO:190 | F-gene coding sequence for isolate NL/1/98 |
| SEQ ID NO:191 | F-gene coding sequence for isolate NL/17/00 |
| SEQ ID NO:192 | F-gene coding sequence for isolate NL/22/01 |
| SEQ ID NO:193 | F-gene coding sequence for isolate NL/29/01 |
| SEQ ID NO:194 | F-gene coding sequence for isolate NL/23/01 |
| SEQ ID NO:195 | F-gene coding sequence for isolate NL/17/01 |
| SEQ ID NO:196 | F-gene coding sequence for isolate NL/24/01 |
| SEQ ID NO:197 | F-gene coding sequence for isolate NL/3/02 |
| SEQ ID NO:198 | F-gene coding sequence for isolate NL/3/98 |
| SEQ ID NO:199 | F-gene coding sequence for isolate NL/1/99 |
| SEQ ID NO:200 | F-gene coding sequence for isolate NL/2/99 |
| SEQ ID NO:201 | F-gene coding sequence for isolate NL/3/99 |
| SEQ ID NO:202 | F-gene coding sequence for isolate NL/11/00 |
| SEQ ID NO:203 | F-gene coding sequence for isolate NL/12/00 |
| SEQ ID NO:204 | F-gene coding sequence for isolate NL/1/01 |
| SEQ ID NO:205 | F-gene coding sequence for isolate NL/5/01 |
| SEQ ID NO:206 | F-gene coding sequence for isolate NL/9/01 |
| SEQ ID NO:207 | F-gene coding sequence for isolate NL/19/01 |
| SEQ ID NO:208 | F-gene coding sequence for isolate NL/21/01 |
| SEQ ID NO:209 | F-gene coding sequence for isolate UK/11/01 |
| SEQ ID NO:210 | F-gene coding sequence for isolate FL/1/01 |
| SEQ ID NO:211 | F-gene coding sequence for isolate FL/2/01 |
| SEQ ID NO:212 | F-gene coding sequence for isolate FL/5/01 |
| SEQ ID NO:213 | F-gene coding sequence for isolate FL/7/01 |
| SEQ ID NO:214 | F-gene coding sequence for isolate FL/9/01 |
| SEQ ID NO:215 | F-gene coding sequence for isolate UK/10/01 |
| SEQ ID NO:216 | F-gene coding sequence for isolate NL/1/02 |
| SEQ ID NO:217 | F-gene coding sequence for isolate NL/1/94 |
| SEQ ID NO:218 | F-gene coding sequence for isolate NL/1/96 |
| SEQ ID NO:219 | F-gene coding sequence for isolate NL/6/97 |
| SEQ ID NO:220 | F-gene coding sequence for isolate NL/7/00 |
| SEQ ID NO:221 | F-gene coding sequence for isolate NL/9/00 |
| SEQ ID NO:222 | F-gene coding sequence for isolate NL/19/00 |
| SEQ ID NO:223 | F-gene coding sequence for isolate NL/28/00 |
| SEQ ID NO:224 | F-gene coding sequence for isolate NL/3/01 |
| SEQ ID NO:225 | F-gene coding sequence for isolate NL/4/01 |
| SEQ ID NO:226 | F-gene coding sequence for isolate NL/11/01 |
| SEQ ID NO:227 | F-gene coding sequence for isolate NL/15/01 |
| SEQ ID NO:228 | F-gene coding sequence for isolate NL/18/01 |
| SEQ ID NO:229 | F-gene coding sequence for isolate FL/6/01 |
| SEQ ID NO:230 | F-gene coding sequence for isolate UK/5/01 |
| SEQ ID NO:231 | F-gene coding sequence for isolate UK/8/01 |
| SEQ ID NO:232 | F-gene coding sequence for isolate NL/12/02 |
| SEQ ID NO:233 | F-gene coding sequence for isolate HK/1/02 |
| SEQ ID NO:234 | F-protein sequence for isolate NL/1/00 |
| SEQ ID NO:235 | F-protein sequence for isolate UK/1/00 |
| SEQ ID NO:236 | F-protein sequence for isolate NL/2/00 |
| SEQ ID NO:237 | F-protein sequence for isolate NL/13/00 |
| SEQ ID NO:238 | F-protein sequence for isolate NL/14/00 |
| SEQ ID NO:239 | F-protein sequence for isolate FL/3/01 |
| SEQ ID NO:240 | F-protein sequence for isolate FL/4/01 |
| SEQ ID NO:241 | F-protein sequence for isolate FL/8/01 |
| SEQ ID NO:242 | F-protein sequence for isolate UK/1/01 |
| SEQ ID NO:243 | F-protein sequence for isolate UK/7/01 |
| SEQ ID NO:244 | F-protein sequence for isolate FL/10/01 |
| SEQ ID NO:245 | F-protein sequence for isolate NL/6/01 |
| SEQ ID NO:246 | F-protein sequence for isolate NL/8/01 |
| SEQ ID NO:247 | F-protein sequence for isolate NL/10/01 |
| SEQ ID NO:248 | F-protein sequence for isolate NL/14/01 |
| SEQ ID NO:249 | F-protein sequence for isolate NL/20/01 |
| SEQ ID NO:250 | F-protein sequence for isolate NL/25/01 |
| SEQ ID NO:251 | F-protein sequence for isolate NL/26/01 |
| SEQ ID NO:252 | F-protein sequence for isolate NL/28/01 |
| SEQ ID NO:253 | F-protein sequence for isolate NL/30/01 |

TABLE 14-continued

LEGEND FOR SEQUENCE LISTING

| | |
|---|---|
| SEQ ID NO:254 | F-protein sequence for isolate BR/2/01 |
| SEQ ID NO:255 | F-protein sequence for isolate BR/3/01 |
| SEQ ID NO:256 | F-protein sequence for isolate NL/2/02 |
| SEQ ID NO:257 | F-protein sequence for isolate NL/4/02 |
| SEQ ID NO:258 | F-protein sequence for isolate NL/5/02 |
| SEQ ID NO:259 | F-protein sequence for isolate NL/6/02 |
| SEQ ID NO:260 | F-protein sequence for isolate NL/7/02 |
| SEQ ID NO:261 | F-protein sequence for isolate NL/9/02 |
| SEQ ID NO:262 | F-protein sequence for isolate FL/1/02 |
| SEQ ID NO:263 | F-protein sequence for isolate NL/1/81 |
| SEQ ID NO:264 | F-protein sequence for isolate NL/1/93 |
| SEQ ID NO:265 | F-protein sequence for isolate NL/2/93 |
| SEQ ID NO:266 | F-protein sequence for isolate NL/4/93 |
| SEQ ID NO:267 | F-protein sequence for isolate NL/1/95 |
| SEQ ID NO:268 | F-protein sequence for isolate NL/2/96 |
| SEQ ID NO:269 | F-protein sequence for isolate NL/3/96 |
| SEQ ID NO:270 | F-protein sequence for isolate NL/1/98 |
| SEQ ID NO:271 | F-protein sequence for isolate NL/17/00 |
| SEQ ID NO:272 | F-protein sequence for isolate NL/22/01 |
| SEQ ID NO:273 | F-protein sequence for isolate NL/29/01 |
| SEQ ID NO:274 | F-protein sequence for isolate NL/23/01 |
| SEQ ID NO:275 | F-protein sequence for isolate NL/17/01 |
| SEQ ID NO:276 | F-protein sequence for isolate NL/24/01 |
| SEQ ID NO:277 | F-protein sequence for isolate NL/3/02 |
| SEQ ID NO:278 | F-protein sequence for isolate NL/3/98 |
| SEQ ID NO:279 | F-protein sequence for isolate NL/1/99 |
| SEQ ID NO:280 | F-protein sequence for isolate NL/2/99 |
| SEQ ID NO:281 | F-protein sequence for isolate NL/3/99 |
| SEQ ID NO:282 | F-protein sequence for isolate NL/11/00 |
| SEQ ID NO:283 | F-protein sequence for isolate NL/12/00 |
| SEQ ID NO:284 | F-protein sequence for isolate NL/1/01 |
| SEQ ID NO:285 | F-protein sequence for isolate NL/5/01 |
| SEQ ID NO:286 | F-protein sequence for isolate NL/9/01 |
| SEQ ID NO:287 | F-protein sequence for isolate NL/19/01 |
| SEQ ID NO:288 | F-protein sequence for isolate NL/21/01 |
| SEQ ID NO:289 | F-protein sequence for isolate UK/11/01 |
| SEQ ID NO:290 | F-protein sequence for isolate FL/1/01 |
| SEQ ID NO:291 | F-protein sequence for isolate FL/2/01 |
| SEQ ID NO:292 | F-protein sequence for isolate FL/5/01 |
| SEQ ID NO:293 | F-protein sequence for isolate FL/7/01 |
| SEQ ID NO:294 | F-protein sequence for isolate FL/9/01 |
| SEQ ID NO:295 | F-protein sequence for isolate UK/10/01 |
| SEQ ID NO:296 | F-protein sequence for isolate NL/1/02 |
| SEQ ID NO:297 | F-protein sequence for isolate NL/1/94 |
| SEQ ID NO:298 | F-protein sequence for isolate NL/1/96 |
| SEQ ID NO:299 | F-protein sequence for isolate NL/6/97 |
| SEQ ID NO:300 | F-protein sequence for isolate NL/7/00 |
| SEQ ID NO:301 | F-protein sequence for isolate NL/9/00 |
| SEQ ID NO:302 | F-protein sequence for isolate NL/19/00 |
| SEQ ID NO:303 | F-protein sequence for isolate NL/28/00 |
| SEQ ID NO:304 | F-protein sequence for isolate NL/3/01 |
| SEQ ID NO:305 | F-protein sequence for isolate NL/4/01 |
| SEQ ID NO:306 | F-protein sequence for isolate NL/11/01 |
| SEQ ID NO:307 | F-protein sequence for isolate NL/15/01 |
| SEQ ID NO:308 | F-protein sequence for isolate NL/18/01 |
| SEQ ID NO:309 | F-protein sequence for isolate FL/6/01 |
| SEQ ID NO:310 | F-protein sequence for isolate UK/5/01 |
| SEQ ID NO:311 | F-protein sequence for isolate UK/8/01 |
| SEQ ID NO:312 | F-protein sequence for isolate NL/12/02 |
| SEQ ID NO:313 | F-protein sequence for isolate HK/1/02 |
| SEQ ID NO:314 | F protein sequence for HMPV isolate NL/1/00 |
| SEQ ID NO:315 | F protein sequence for HMPV isolate NL/17/00 |
| SEQ ID NO:316 | F protein sequence for HMPV isolate NL/1/99 |
| SEQ ID NO:317 | F protein sequence for HMPV isolate NL/1/94 |
| SEQ ID NO:318 | F-gene sequence for HMPV isolate NL/1/00 |
| SEQ ID NO:319 | F-gene sequence for HMPV isolate NL/17/00 |
| SEQ ID NO:320 | F-gene sequence for HMPV isolate NL/1/99 |
| SEQ ID NO:321 | F-gene sequence for HMPV isolate NL/1/94 |
| SEQ ID NO:322 | G protein sequence for HMPV isolate NL/1/00 |
| SEQ ID NO:323 | G protein sequence for HMPV isolate NL/17/00 |
| SEQ ID NO:324 | G protein sequence for HMPV isolate NL/1/99 |
| SEQ ID NO:325 | G protein sequence for HMPV isolate NL/1/94 |
| SEQ ID NO:326 | G-gene sequence for HMPV isolate NL/1/00 |
| SEQ ID NO:327 | G-gene sequence for HMPV isolate NL/17/00 |
| SEQ ID NO:328 | G-gene sequence for HMPV isolate NL/1/99 |
| SEQ ID NO:329 | G-gene sequence for HMPV isolate NL/1/94 |
| SEQ ID NO:330 | L protein sequence for HMPV isolate NL/1/00 |
| SEQ ID NO:331 | L protein sequence for HMPV isolate NL/17/00 |
| SEQ ID NO:332 | L protein sequence for HMPV isolate NL/1/99 |
| SEQ ID NO:333 | L protein sequence for HMPV isolate NL/1/94 |
| SEQ ID NO:334 | L-gene sequence for HMPV isolate NL/1/00 |
| SEQ ID NO:335 | L-gene sequence for HMPV isolate NL/17/00 |
| SEQ ID NO:336 | L-gene sequence for HMPV isolate NL/1/99 |
| SEQ ID NO:337 | L-gene sequence for HMPV isolate NL/1/94 |
| SEQ ID NO:338 | M2-1 protein sequence for HMPV isolate NL/1/00 |
| SEQ ID NO:339 | M2-1 protein sequence for HMPV isolate NL/17/00 |
| SEQ ID NO:340 | M2-1 protein sequence for HMPV isolate NL/1/99 |
| SEQ ID NO:341 | M2-1 protein sequence for HMPV isolate NL/1/94 |
| SEQ ID NO:342 | M2-1 gene sequence for HMPV isolate NL/1/00 |
| SEQ ID NO:343 | M2-1 gene sequence for HMPV isolate NL/17/00 |
| SEQ ID NO:344 | M2-1 gene sequence for HMPV isolate NL/1/99 |
| SEQ ID NO:345 | M2-1 gene sequence for HMPV isolate NL/1/94 |
| SEQ ID NO:346 | M2-2 protein sequence for HMPV isolate NL/1/00 |
| SEQ ID NO:347 | M2-2 protein sequence for HMPV isolate NL/17/00 |
| SEQ ID NO:348 | M2-2 protein sequence for HMPV isolate NL/1/99 |
| SEQ ID NO:349 | M2-2 protein sequence for HMPV isolate NL/1/94 |
| SEQ ID NO:350 | M2-2 gene sequence for HMPV isolate NL/1/00 |
| SEQ ID NO:351 | M2-2 gene sequence for HMPV isolate NL/17/00 |
| SEQ ID NO:352 | M2-2 gene sequence for HMPV isolate NL/1/99 |
| SEQ ID NO:353 | M2-2 gene sequence for HMPV isolate NL/1/94 |
| SEQ ID NO:354 | M2 gene sequence for HMPV isolate NL/1/00 |
| SEQ ID NO:355 | M2 gene sequence for HMPV isolate NL/17/00 |
| SEQ ID NO:356 | M2 gene sequence for HMPV isolate NL/1/99 |
| SEQ ID NO:357 | M2 gene sequence for HMPV isolate NL/1/94 |
| SEQ ID NO:358 | M protein sequence for HMPV isolate NL/1/00 |
| SEQ ID NO:359 | M protein sequence for HMPV isolate NL/17/00 |
| SEQ ID NO:360 | M protein sequence for HMPV isolate NL/1/99 |
| SEQ ID NO:361 | M protein sequence for HMPV isolate NL/1/94 |
| SEQ ID NO:362 | M gene sequence for HMPV isolate NL/1/00 |
| SEQ ID NO:363 | M gene sequence for HMPV isolate NL/17/00 |
| SEQ ID NO:364 | M gene sequence for HMPV isolate NL/1/99 |
| SEQ ID NO:365 | M gene sequence for HMPV isolate NL/1/94 |
| SEQ ID NO:366 | N protein sequence for HMPV isolate NL/1/00 |
| SEQ ID NO:367 | N protein sequence for HMPV isolate NL/17/00 |
| SEQ ID NO:368 | N protein sequence for HMPV isolate NL/1/99 |
| SEQ ID NO:369 | N protein sequence for HMPV isolate NL/1/94 |
| SEQ ID NO:370 | N gene sequence for HMPV isolate NL/1/00 |
| SEQ ID NO:371 | N gene sequence for HMPV isolate NL/17/00 |
| SEQ ID NO:372 | N gene sequence for HMPV isolate NL/1/99 |
| SEQ ID NO:373 | N gene sequence for HMPV isolate NL/1/94 |
| SEQ ID NO:374 | P protein sequence for HMPV isolate NL/1/00 |
| SEQ ID NO:375 | P protein sequence for HMPV isolate NL/17/00 |
| SEQ ID NO:376 | P protein sequence for HMPV isolate NL/1/99 |
| SEQ ID NO:377 | P protein sequence for HMPV isolate NL/1/94 |
| SEQ ID NO:378 | P gene sequence for HMPV isolate NL/1/00 |
| SEQ ID NO:379 | P gene sequence for HMPV isolate NL/17/00 |
| SEQ ID NO:380 | P gene sequence for HMPV isolate NL/1/99 |
| SEQ ID NO:381 | P gene sequence for HMPV isolate NL/1/94 |
| SEQ ID NO:382 | SH protein sequence for HMPV isolate NL/1/00 |
| SEQ ID NO:383 | SH protein sequence for HMPV isolate NL/17/00 |
| SEQ ID NO:384 | SH protein sequence for HMPV isolate NL/1/99 |
| SEQ ID NO:385 | SH protein sequence for HMPV isolate NL/1/94 |
| SEQ ID NO:386 | SH gene sequence for HMPV isolate NL/1/00 |
| SEQ ID NO:387 | SH gene sequence for HMPV isolate NL/17/00 |
| SEQ ID NO:388 | SH gene sequence for HMPV isolate NL/1/99 |
| SEQ ID NO:389 | SH gene sequence for HMPV isolate NL/1/94 |

SEQUENCE LISTING (389 sequences)

SEQ ID NO: 1 - DNA, 2507 bp, metapneumovirus
  CDS (1)...(2507): Human metapneumovirus isolate 00-1 matrix protein (M) and fusion protein (F) genes
atggagtcctacctagtagacacctatcaaggcattccttacacagcagctgttcaagttgatctaatagaaaaggacctgttacctgcaagcctaacaatatggttccctttgtttcaggccaacacaccaccagcagtgctgctcgatcagctaaaaaccctgacaataaccactctgtatgctgcatcacaaaatggtccaatactcaaagtgaatgcatcagcccaaggtgcagcaatgtctgtacttcccaaaaaatttgaagtcaatgcgactgtagcactcgatgaatatagcaaactggaatttgacaaactcacagtctgtgaagtaaaaacagtttacttaacaaccatgaaaccatacgggatggtatcaaaatttgtgagctcagccaaatcagttggcaaaaaaacacatgatctaatcgcactatgtgattttatggatctagaaaagaacacacctgttacaataccagcattcatcaaatcagtttcaatcaaagagagtgagtcagctactgttgaagctgctataagcagtgaagcagaccaagctctaacacaggccaaaattgcaccttatgcgggattaattatgatcatgactatgaacaatcccaaaggcatattcaaaaagcttggagctgggactcaagtcatagtagaactaggagcatatgtccaggctgaaagcataagcaaaatatgcaagacttggagccatcaagggacaagatatgtcttgaagtccagataacaaccaagcaccttggccaagagctactaaccctatctcatagatcataaagtcaccattctagttatataaaaatcaagttagaacaagaattaaatcaatcaagaacgggacaaataaaaatgtcttggaaagtggtgatcattttttcattgttaataacacctcaacacggtcttaaagagagctacttagaagagtcatgtagcactataactgaaggatatctcagtgttctgaggacaggttggtacaccaatgtttttacactggaggtaggcgatgtagagaaccttacatgtgccgatggacccagcttaataaaaacagaattagacctgaccaaaagtgcactaagagagctcagaacagtttctgctgatcaactggcaagagaggagcaaattgaaaatcccagacaatctagattcgttctaggagcaatagcactcggtgttgcaactgcagctgcagttacagcaggtgttgcaattgccaaaaccatccggcttgaaagtgaagtaacagcaattaagaatgccctcaaaaagaccaatgaagcagtatctacattggggaatggagttcgtgtgttggcaactgcagtgagagagctgaaagattttgtgagcaagaatctaacacgtgcaatcaacaaaaacaagtgcgacattgctgacctgaaaatggccgttagcttcagtcaattcaacagaaggttcctaaatgttgtgcggcaattttcagacaacgctggaataacaccagcaatatctttggacttaatgacagatgctgaactagccagagctgtttccaacatgccaacatctgcaggacaaataaaactgatgttggagaaccgtgcaatggtaagaagaaaagggttcggattcctgataggagtttacggaagctccgtaatttacatggtgcaactgccaatctttggggttatagacacgccttgctggatagtaaaagcagccccttcttgttcaggaaaaaagggaaactatgcttgcctcttaagagaagaccaaggatggtattgtcaaaatgcagggtcaactgtttactacccaaatgaaaaagactgtgaaacaagaggagaccatgtcttttgcgacacagcagcaggaatcaatgttgctgagcagtcaaaggagtgcaacataaacatatctactactaattacccatgcaaagttagcacaggaagacatcctatcagtatggttgcactatctcctcttggggctttggttgcttgctacaagggagtgagctgttccattggcagcaacagagtagggatcatcaagcaactgaacaaaggctgctcttatataaccaaccaagacgcagacacagtgacaatagacaacactgtataccagctaagcaaagttgaaggcgaacagcatgttataaaaggaaggccagtgtcaagcagctttgacccagtcaagtttcctgaagatcaattcaatgttgcacttgaccaagttttcgagagcattgagaacagtcaggccttggtggatcaatcaaacagaatcctaagcagtgcagagaaaggaaacactggcttcatcattgtaataattctaattgctgtccttggctctaccatgatcctagtgagtgtttttatcataataaagaaaacaaagagacccacaggagcacctccagagctgagtggtgtcacaaacaatggcttcataccacataattag

SEQ ID NO: 2 - DNA, 1596 bp, pneumvirus
  CDS (1)...(1596): Avian pneumovirus fusion protein gene, partial cds
atgtcttggaaagtggtactgctattggtattgctagctaccccaacgggggggctagaagaaagttatctagaggagtcatgcagtactgttactagaggatacctgagtgttttgaggacaggatggtatacaaatgtgttcacacttggggttggagatgtgaaaaatctcacatgtaccgacgggcccagcttaataagaacagaacttgaactgacaaaaaatgcacttgaggaactcaagacagtatcagcagatcaattggcaaaggaagctaggataatgtcaccaagaaaagcccggtttgttctgggtgccatagcattaggtgtggcaactgctgctgctgtgacggctggtgtagcgatagccaagacaattaggctagaaggagaagtggctgcaatcaaaggtgcgctcaggaaaacaaatgaggctgtatctacattaggaaatggcgtgagggtacttgcaacagctgtgaatgatctcaaggactttataagtaaaaaattgacacctgcaataaacaggaacaagtgtgacatctcagaccttaagatggcagtgagctttggacaatacaatcggaggttcctcaatgtggtaagacagttttctgacaatgcaggtattacgcctgcaatatctctagatttaatgactgacgctgagcttgtaagagctgtaagcaacatgcccacatcttcaggacagatcaatctgatgcttgagaatcgggcaatggtcagaaggaaaggatttgggattttgattggagtttatggtagctctgtggtctatatagtgcagcttcctattttcggtgtgatagatacaccgtgttggagggtgaaggctgctccattatgttcagggaaagacgggaattatgcatgtctcttgcgagaggaccaaggttggtattgtcaaaatgctggatccacagtttattatccaaatgaggaggactgtgaagtaagaagtgatcatgtgttttgtgacacagcagctgggataaatgtagcaaaggagtcagaagagtgcaacaggaatatctcaacaacaaagtacccttgcaaggtaagtacagggcgtcacccaataagcatggtggccttatcaccactgggtgctttggtagcctgttatgacggtatgagttgttccattggaagcaacaaggttggaataatcagacctttggggaaagggtgttcatacatcagcaatcaagatgctgacactgttacaattgacaacacagtgtaccaattgagcaaagttgaaggagaacaacacacaattaaagggaagccagtatctagcaattttgaccctatagagttccctgaagatcagttcaacgtagccctggatcaggtgtttgaaagtgttgagaagagtcagaatctgatagaccagtcaaacaagatattggatagcattgaaaaggggaatgcaggatttgtcatagtgatagtcctcattgtcctgctcatgctggcagcagttggtgtgggtgtcttctttgtggttaagaagagaaaagctgctcccaaattcccaatggaaatgaatggtgtgaacaac

SEQ ID NO: 3 - DNA, 1666 bp, pneumovirus
  CDS (14)...(1627): Avian pneumovirus isolate 1b fusion protein mRNA, complete cds
gggacaagtgaaaatgtcttggaaagtggtactgctattggtattgctagctaccccaacgggggggctagaagaaagttatctagaggagtcatgcagtactgttactagaggatacctgagtgttttgaggacaggatggtatacaaatgtgttcacacttgaggttggagatgtggaaaatctcacatgtaccgacgggcccagcttaataagaacagaacttgaactgacaaaaaatgcacttgaggaactcaagacagtatcagcagatcaattggcaaaggaagctaggataatgtcaccaagaaaagcccggtttgttctgggtgccatagcattaggtgtggcaactgctgctgctgtgacggctggtgtagcgatagccaagacaattaggctagaaggagaagtggctgcaatcaagggtgcgctcaggaaaacaaatgaggctgtatctacattaggaaatggcgtgagggtacttgcaacagctgtgaatgatctcaaggactttataagtaaaaaattgacacctgcaataaacaggaacaagtgtgacatctcagaccttaagatggcagtgagctttggacaatacaatcggaggttcctcaatgtggtaagacagttttctgacaatgcaggtattacgcctgcaatatctctagatttaatgactgacgctgagcttgtaagagctgtaagcaacatgcccacatcttcaggacagatcaatctgatgcttgagaatcgggcaatggtcagaaggaaaggatttgggattttgattggagtttatggtagctctgtggtctatatagtgcagcttcctattttcggtgtgatagatacaccgtgttggaaggtgaaggctgctccattatgttcagggaaagacgggaattatgcatgtctcttgcgagaggaccaaggttggtattgtcaaaatgctggatccacagtttattatccaaatgaggaggactgtgaagtaagaagtgatcatgtgttttgtgacacagcagctgggataaatgtagcaaaggagtcagaagagtgcaacaggaatatctcaacaacaaagtacccttgcaaggtaagtacagggcgtcacccaataagcatggtggccttatcaccactgggtgctttggtagcctgttatgacggtatgagttgttccattggaagcaacaaggttggaataatcagacctttggggaaagggtgttcatacatcagcaatcaagatgctgacactgttacaattgacaacacagtgtaccaattgagcaaagttgaaggagaacaacacacaattaaagggaagccagtatctagcaattttgaccctatagagttccctgaagatcagttcaacgtagccctggatcaggtgtttgaaagtgttgagaagagtcagaatctgatagaccagtcaaacaagatattggatagcattgaaaaggggaatgcaggatttgtcatagtgatagtcctcattgtcctgctcatgctggcagcagttggtgtgggtgtcttctttgtggttaagaagagaaaagctgctcccaaattcccaatggaaatgaatggtgtgaacaacaaaggatttatcccttaattttagttattaaaaaaaaaaaaaaaaaaaaaaaaaaaa

SEQ ID NO: 4 - DNA, 1636 bp, rhinotracheitis virus
  CDS (13)...(1629): Turkey rhinotracheitis virus gene for fusion protein (F1 and F2 subunits), complete cds
gggacaagtaggatggatgtaagaatctgtctcctattgttccttatatctaatcctagtagctgcatacaagaaacatacaatgaagaatcctgcagtactgtaactagaggttataagagtgtgttaaggacagggtggtatacgaatgtatttaacctcgaaatagggaatgttgagaacatcacttgcaatgatggacccagcctaattgacactgagttagtactcacaaagaatgctttgagggagctcaaaacagtgtcagctgatcaagtggctaaggaaagcagactatcctcacccaggagacgtagatttgtactgggtgcaatagcacttggtgttgcgacagctgctgccgtaacagctggtgtagcacttgcaaagacaattagattagagggagaggtgaaggcaattaagaatgccctccggaacacaaatgaggcagtatccacattagggaatggtgtgagggtactagcaactgcagtcaatgacctcaaagaatttataagtaaaaaattgactcctgctattaaccagaacaaatgcaatatagcagatataaagatggcaattagttttggccaaaataacagaaggttcctgaatgtggtgaggcaattctctgatagtgcaggtatcacatcagctgtgtctcttgatttaatgacagatgatgaacttgttagagcaattaacagaatgccaacttcatcaggacagattagtttgatgttgaacaatcgtgccatggttagaaggaaggggtttggtatattgattggtgtttatgatggaacggtcgtttatatggtacaactgcccatattcggcgtgattgagacaccttgttggagggtggtggcagcaccactctgtaggaaagagaaaggcaattatgcttgtatactgagagaagatcaagggtggtactgtacaaatgctggctctacagcttattatcctaataaagatgattgtgaggtaagggatgattatgtattttgtgacacagcagctggcattaatgtggccctagaagttgaacagtgcaactataacatatcgacttctaaatacccatgcaaagtcagcacaggtagacaccctgtcagtatggtagccttaacccccctagggggtctagtgtcttgttatgagagtgtaagttgctccataggtagcaataaagtagggataataaaacagctaggcaaagggtgcacccacattcccaacaacgaagctgacacgataaccattgataacactgtgtaccaattgagcaaggttgtaggcgaacagaggaccataaaaggagctccagttgtgaacaattttaacccaatattattccctgaggatcagttcaatgttgcacttgaccaagtatttgagagtatagatagatctcaggacttaatagataagtctaacgacttgctaggtgcagatgccaagagcaaggctggaattgctatagcaatagtagtgctagtcattctaggaatcttctttttacttgcagtgatatattactgttccagagtccggaagaccaaaccaaagcatgattacccggccacgacaggtcatagcagcatggcttatgtcagttaagttattt

SEQ ID NO: 5 - DNA, 1860 bp, pneumovirus
  CDS (1)...(110): Avian pneumovirus matrix protein (M) gene, partial cds
  CDS (216)...(1829): Avian pneumovirus fusion glycoprotein (F) gene, complete cds
gagttcaggtaatagtggagttaggggcatacgttcaagcagaaagcataagcagaatctgcaggaactggagccaccagggtacgagatatgtcctgaagtcaagataaacacagagagtacacttaccaaatcacagtaacaatttcgtttttaaccctctcatagttattacctagcttgatattatttagaaaaaattgggacaagtgaaaatgtcttggaaagtggtactgctattggtattgctagctaccccaacgggggggctagaagaaagttatctagaggagtcatgcagtactgttactagaggatacctgagtgttttgaggacaggatggtatacaaatgtgttcacacttgaggttggagatgtggaaaatctcacatgtaccgacgggcccagcttaataagaacagaacttgaactgacaaaaaatgcacttgaggaactcaagacagtatcagcagatcaattggcaaaggaagctaggataatgtcaccaagaaaagcccggtttgttctgggtgccatagcattaggtgtggcaactgctgctgctgtgacggctggtgtagcgatagccaagacaattaggctagaaggagaagtggctgcaatcaagggtgcgctcaggaaaacaaatgaggctgtatctacattaggaaatggcgtgagggtacttgcaacagctgtgaatgatctcaaggactttataagtaaaaaattgacacctgcaataaacaggaacaagtgtgacatctcagaccttaagatggcagtgagctttggacaatacaatcggaggttcctcaatgtggtaagacagttttctgacaatgcaggtattacgcctgcaatatctctagatttaatgactgacgctgagcttgtaagagctgtaagcaacatgcccacatcttcaggacagatcaatctgatgcttgagaatcgggcaatggtcagaaggaaaggatttgggattttgattggagtttatggtagctctgtggtctatatagtgcagcttcctattttcggtgtgatagatacaccgtgttggaaggtgaaggctgctccattatgttcagggaaagacgggaattatgcatgtctcttgcgagaggaccaaggttggtattgtcaaaatgctggatccacagtttattatccaaatgaggaggactgtgaagtaagaagtgatcatgtgttttgtgacacagcagctgggataaatgtagcaaaggagtcagaagagtgcaacaggaatatctcaacaacaaagtacccttgcaaggtaagtacagggcgtcacccaataagcatggtggccttatcaccactgggtgctttggtagcctgttatgacggtatgagttgttccattggaagcaacaaggttggaataatcagacctttggggaaagggtgttcatacatcagcaatcaagatgctgacactgttacaattgacaacacagtgtaccaattgagcaaagttgaaggagaacaacacacaattaaagggaagccagtatctagcaattttgaccctatagagttccctgaagatcagttcaacatagccctggatcaggtgtttgaaagtgttgagaagagtcagaatctgatagaccagtcaaacaagatattggatagcattgaaaaggggaatgcaggatttgtcatagtgatagtcctcattgtcctgctcatgctggcagcagttggtgtgggtgtcttctttgtggttaagaagagaaaagctgctcccaaattcccaatggaaatgaatggtgtgaacaacaaaggatttatcccttaattttagttactaaaaaattgggacaagtgaa

SEQ ID NO: 6 - protein, 574 aa, paramyxovirus
  paramyxovirus F protein hRSV B
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 7 - protein, 574 aa, paramyxovirus
  paramyxovirus F protein hRSV A2
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 8 - protein, 121 aa, metapneumovirus
  human metapneumovirus01-71 (partial sequence)
LLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLE

SEQ ID NO: 9 - protein, 539 aa, metapneumovirus
  Human metapneumovirus isolate 00-1 matrix protein (M) and fusion protein (F) genes
MSWKVVIIFSLLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGFLIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKRPTGAPPELSGVTNNGFIPHN

SEQ ID NO: 10 - protein, 532 aa, Avian pneumovirus
  Avian pneumovirus fusion protein gene, partial cds
MSWKVVLLLVLLATPTGGLEESYLEESCSTVTRGYLSVLRTGWYTNVFTLGVGDVKNLTCTDGPSLIRTELELTKNALEELKTVSADQLAKEARIMSPRKARFVLGAIALGVATAAAVTAGVAIAKTIRLEGEVAAIKGALRKTNEAVSTLGNGVRVLATAVNDLKDFISKKLTPAINRNKCDISDLKMAVSFGQYNRRFLNVVRQFSDNAGITPAISLDLMTDAELVRAVSNMPTSSGQINLMLENRAMVRRKGFGILIGVYGSSVVYIVQLPIFGVIDTPCWRVKAAPLCSGKDGNYACLLREDQGWYCQNAGSTVYYPNEEDCEVRSDHVFCDTAAGINVAKESEECNRNISTTKYPCKVSTGRHPISMVALSPLGALVACYDGMSCSIGSNKVGIIRPLGKGCSYISNQDADTVTIDNTVYQLSKVEGEQHTIKGKPVSSNFDPIEFPEDQFNVALDQVFESVEKSQNLIDQSNKILDSIEKGNAGFVIVIVLIVLLMLAAVGVGVFFVVKKRKAAPKFPMEMNGVNN

SEQ ID NO: 11 - protein, 537 aa, Avian pneumovirus
  Avian pneumovirus isolate 1b fusion protein mRNA, complete cds
MSWKVVLLLVLLATPTGGLEESYLEESCSTVTRGYLSVLRTGWYTNVFTLEVGDVENLTCTDGPSLIRTELELTKNALEELKTVSADQLAKEARIMSPRKARFVLGAIALGVATAAAVTAGVAIAKTIRLEGEVAAIKGALRKTNEAVSTLGNGVRVLATAVNDLKDFISKKLTPAINRNKCDISDLKMAVSFGQYNRRFLNVVRQFSDNAGITPAISLDLMTDAELVRAVSNMPTSSGQINLMLENRAMVRRKGFGILIGVYGSSVVYIVQLPIFGVIDTPCWKVKAAPLCSGKDGNYACLLREDQGWYCQNAGSTVYYPNEEDCEVRSDHVFCDTAAGINVAKESEECNRNISTTKYPCKVSTGRHPISMVALSPLGALVACYDGMSCSIGSNKVGIIRPLGKGCSYISNQDADTVTIDNTVYQLSKVEGEQHTIKGKPVSSNFDPIEFPEDQFNVALDQVFESVEKSQNLIDQSNKILDSIEKGNAGFVIVIVLIVLLMLAAVGVGVFFVVKKRKAAPKFPMEMNGVNNKGFIP

SEQ ID NO: 12 - protein, 538 aa, Turkey rhinotracheitis virus
  Turkey rhinotracheitis virus gene for fusion protein (F1 and F2 subunits), complete cds
MDVRICLLLFLISNPSSCIQETYNEESCSTVTRGYKSVLRTGWYTNVFNLEIGNVENITCNDGPSLIDTELVLTKNALRELKTVSADQVAKESRLSSPRRRRFVLGAIALGVATAAAVTAGVALAKTIRLEGEVKAIKNALRNTNEAVSTLGNGVRVLATAVNDLKEFISKKLTPAINQNKCNIADIKMAISFGQNNRRFLNVVRQFSDSAGITSAVSLDLMTDDELVRAINRMPTSSGQISLMLNNRAMVRRKGFGILIGVYDGTVVYMVQLPIFGVIETPCWRVVAAPLCRKEKGNYACILREDQGWYCTNAGSTAYYPNKDDCEVRDDYVFCDTAAGINVALEVEQCNYNISTSKYPCKVSTGRHPVSMVALTPLGGLVSCYESVSCSIGSNKVGIIKQLGKGCTHIPNNEADTITIDNTVYQLSKVVGEQRTIKGAPVVNNFNPILFPEDQFNVALDQVFESIDRSQDLIDKSNDLLGADAKSKAGIAIAIVVLVILGIFFLLAVIYYCSRVRKTKPKHDYPATTGHSSMAYVS

SEQ ID NO: 13 - protein, 537 aa, Avian penumovirus
  Avian pneumovirus fusion glycoprotein (F) gene, complete cds
MSWKVVLLLVLLATPTGGLEESYLEESCSTVTRGYLSVLRTGWYTNVFTLEVGDVENLTCTDGPSLIRTELELTKNALEELKTVSADQLAKEARIMSPRKARFVLGAIALGVATAAAVTAGVAIAKTIRLEGEVAAIKGALRKTNEAVSTLGNGVRVLATAVNDLKDFISKKLTPAINRNKCDISDLKMAVSFGQYNRRFLNVVRQFSDNAGITPAISLDLMTDAELVRAVSNMPTSSGQINLMLENRAMVRRKGFGILIGVYGSSVVYIVQLPIFGVIDTPCWKVKAAPLCSGKDGNYACLLREDQGWYCQNAGSTVYYPNEEDCEVRSDHVFCDTAAGINVAKESEECNRNISTTKYPCKVSTGRHPISMVALSPLGALVACYDGMSCSIGSNKVGIIRPLGKGCSYISNQDADTVTIDNTVYQLSKVEGEQHTIKGKPVSSNFDPIEFPEDQFNIALDQVFESVEKSQNLIDQSNKILDSIEKGNAGFVIVIVLIVLLMLAAVGVGVFFVVKKRKAAPKFPMEMNGVNNKGFIP

SEQ ID NO: 14 - DNA, 1193 bp, rhinotracheitis virus
  CDS (16)...(1191): Turkey rhinotracheitis virus (strain CVL14/1) attachment protien (G) mRNA, complete cds
gggacaagtatctctatggggtccaaactatatatggctcagggcaccagtgcatatcaaactgcagtggggttctggctggacatcgggaggaggtacatattggctatagtcctatcagctttcgggctgacctgcacagtcactattgcactcactgttagcgtcatagttgaacagtcagtgttagaggagtgcagaaactacaatggaggagatagagattggtggtcaaccacccaggagcagccaactactgcaccaagtgcgactccagcaggaaattatggaggattacaaacggctcgaacaagaaagtctgaaagctgtttgcatgtgcaaatttcttatggtgatatgtatagccgcagtgatactgtactgggtggttttgattgtatgggcttattggttctttgcaaatcaggaccaatttgtcagcgagataatcaagttgacccaacagccctctgccattgcagggtagatctttcaagtgtggactgctgcaaggtgaacaagattagcactaacagcagcaccacctctgagccccagaagaccaacccggcatggcctagccaagacaacacagactccgatccaaatccccaaggcataaccaccagcacagccactctgctctcaacaagtctgggcctcatgctcacatcgaagactgggacacacaaatcagggcccccccaagccttgccggggagcaacaccaacggaaaaacaaccacagaccgagaaccagggcccacaaaccaaccaaattcaaccaccaatgggcaacacaataaacacacccaacgaatgacacccccgccaagtcacgacaacacaagaaccatcctccagcacacaacaccctgggaaaagacattcagtacatacaagcccacacactctccgaccaacgaatcagatcaatccctccccacaactcaaaacagcatcaactgtgaacattttgacccccaaggcaaggaaaaaatctgctacagagtaggttcttacaactccaatattacaaagcaatgcagaattgatgtgcctttgtgttccacttatagcacagtgtgcatgaaaacatactataccgaaccattcaactgttggaggcgtatctggcgttgcttgtgtgatgacggagttggtctggttgagtggtgttgcactagttaact

SEQ ID NO: 15 - DNA, 1260 bp, rhinotracheitis virus
  CDS (16)...(1260): Turkey rhinotracheitis virus (strain 6574) attachment protein (G), complete cds
gggacaagtatccagatggggtcagagctctacatcatagagggggtgagctcatctgaaatagtcctcaagcaagtcctcagaaggagccaaaaaatactgttaggactggtgttatcagccttaggcttgacgctcactagcactattgttatatctatttgtattagtgtagaacaggtcaaattacgacagtgtgtggacacttattgggcggaaaatggatccttacatccaggacagtcaacagaaaatacttcaacaagaggtaagactacaacaaaagaccctagaagattacaggcgactggagcaggaaagtttgagagctgtgggtatgtgcaagttgttgatggtgatatgcatgatcgcagttatgctgtactgggtggtgttgattgtttgggcttattggctctttgtgaatcaggaccaatttgtcagggagatacttggtctgaagacggaaacttctgccgatgcactttttcttcccatggggtgagttgctgcaaaaaacccaaaagcaaggcaaccactgcccagaggaactccaaaccagctaacagcaaatcaactcctccggtacattcagacagggccagcaaagaacataatccctcccaaggggagcaaccccgcagggggccaaccagcagcaagacaactattgctagcaccccttcaacagaggacactgctaaaccaacgattagcaaacctaaactcaccatcaggccctcgcaaagaggtccatccggcagcacaaaagcagcctccagcacccccagccacaagaccaacaccagaggcaccagcaagacgaccgaccagagaccccgcaccggacccactcccgaaaggcccagacaaacccacagcacagcaactccgccccccacaaccccaatccacaagggccgggccccaacccccaaaccaacaacagacctcaaggtcaacccaagggaaggcagcacaagcccaactgcaatacagaaaaacccaaccacacaaagtaatcttgttgactgcacactgtctgatccagatgagccacaaaggatttgttaccaggtaggaacttacaatcctagtcaatcgggaacctgcaacatagaggttccaaaatgttccacttatgggcatgcttgtatggctacattatatgacaccccattcaactgctggcgcaggaccaggagatgcatctgtgattccggaggggagctgattgagtggtgctgtactagtcaataa

SEQ ID NO: 16 - protein, 391 aa, Turkey rhinotracheitis virus
  Turkey rhinotracheitis virus (strain CVL14/1) attachment protien (G) mRNA, complete cds
MGSKLYMAQGTSAYQTAVGFWLDIGRRYILAIVLSAFGLTCTVTIALTVSVIVEQSVLEECRNYNGGDRDWWSTTQEQPTTAPSATPAGNYGGLQTARTRKSESCLHVQISYGDMYSRSDTVLGGFDCMGLLVLCKSGPICQRDNQVDPTALCHCRVDLSSVDCCKVNKISTNSSTTSEPQKTNPAWPSQDNTDSDPNPQGITTSTATLLSTSLGLMLTSKTGTHKSGPPQALPGSNTNGKTTTDREPGPTNQPNSTTNGQHNKHTQRMTPPPSHDNTRTILQHTTPWEKTFSTYKPTHSPTNESDQSLPTTQNSINCEHFDPQGKEKICYRVGSYNSNITKQCRIDVPLCSTYSTVCMKTYYTEPFNCWRRIWRCLCDDGVGLVEWCCTS

SEQ ID NO: 17 - protein, 414 aa, rhinotracheitis virus
  Turkey rhinotracheitis virus (strain 6574) attachment protein (G), complete cds
MGSELYIIEGVSSSEIVLKQVLRRSQKILLGLVLSALGLTLTSTIVISICISVEQVKLRQCVDTYWAENGSLHPGQSTENTSTRGKTTTKDPRRLQATGAGKFESCGYVQVVDGDMHDRSYAVLGGVDCLGLLALCESGPICQGDTWSEDGNFCRCTFSSHGVSCCKKPKSKATTAQRNSKPANSKSTPPVHSDRASKEHNPSQGEQPRRGPTSSKTTIASTPSTEDTAKPTISKPKLTIRPSQRGPSGSTKAASSTPSHKTNTRGTSKTTDQRPRTGPTPERPRQTHSTATPPPTTPIHKGRAPTPKPTTDLKVNPREGSTSPTAIQKNPTTQSNLVDCTLSDPDEPQRICYQVGTYNPSQSGTCNIEVPKCSTYGHACMATLYDTPFNCWRRTRRCICDSGGELIEWCCTSQ

SEQ ID NO: 18 - DNA, 13294 bp, human metapneumo virus
  misc_feature (0)...(0): human MPV protein
acgcgaaaaaaacgcgtataaattaaattccaaacaaaacgggacaaataaaaatgtctcttcaagggattcacctaagtgatctatcatataaacatgctatattaaaagagtctcaatacacaataaaaagagatgtaggcaccacaactgcagtgacaccttcatcattacaacaagaaataacacttttgtgtggggaaatactttacactaaacacactgattacaaatatgctgctgagataggaatacaatatatttgcacagctctaggatcagaaagagtacaacagattttgagaaactcaggtagtgaagttcaggtggttctaaccaaaacatactccttagggaaaggcaaaaacagtaaaggggaagagctgcagatgttagatatacatggagtggaaaagagttggatagaagaaatagacaaagaggcaagaaagacaatggtaactttgcttaaggaatcatcaggtaacatcccacaaaaccagagaccttcagcaccagacacaccaataattttattatgtgtaggtgccctaatattcactaaactagcatcaacaatagaagttggattagagactacagttagaagagctaatagagtgctaagtgatgcactcaaaagatacccaaggatagatataccaaagattgctagatctttttatgaactatttgaacaaaaagtgtactacagaagtttattcattgagtacggaaaagctttaggctcatcttcaacaggaagcaaagcagaaagtttgtttgtaaatatatttatgcaagcttatggagctggccaaacactgctaaggtggggtgtcattgccagatcatccaacaacataatgctagggcatgtatctgtgcaatctgaattgaagcaagttacagaggtttatgacttggtgagagaaatgggtcctgaatctgggcttttacatctaagacaaagtccaaaggcagggctgttatcattggccaattgccccaattttgctagtgttgttcttggcaatgcttcaggtctaggcataatcggaatgtacagagggagagtaccaaacacagagctattttctgcagcagaaagttatgccagaagcttaaaagaaagcaataaaatcaacttctcttcgttagggcttacagatgaagaaaaagaagctgcagaacacttcttaaacatgagtggtgacaatcaagatgattatgagtaattaaaaaactgggacaagtcaaaatgtcattccctgaaggaaaggatattctgttcatgggtaatgaagcagcaaaaatagccgaagctttccagaaatcactgaaaaaatcaggtcacaagagaactcaatctattgtaggggaaaaagttaacactatatcagaaactctagaactacctaccatcagcaaacctgcacgatcatctacactgctggaaccaaaattggcatgggcagacaacagcggaatcaccaaaatcacagaaaaaccagcaaccaaaacaacagatcctgttgaagaagaggaattcaatgaaaagaaagtgttaccttccagtgatgggaagactcctgcagagaaaaaatcaaagttttcaaccagtgtaaaaaagaaagtttcctttacatcaaatgaaccagggaaatacaccaaactagagaaagatgccctagatttgctctcagacaatgaggaagaagacgcagaatcctcaatcctaacttttgaggagaaagatacatcatcactaagcattgaagctagactagaatctatagaagagaagttgagcatgatattaggactgcttcgtacacttaacattgcaacagcaggaccaacagctgcacgagatggaattagggatgcaatgattggtataagagaagagctaatagcagagataattaaggaagccaagggaaaagcagctgaaatgatggaagaagagatgaatcaaagatcaaaaataggaaatggcagtgtaaaactaaccgagaaggcaaaagagctcaacaaaattgttgaagacgagagcacaagcggtgaatcagaagaagaagaagaaccaaaagaaactcaggataacaatcaaggagaagatatttatcagttaatcatgtagtttaataaaaataaacaatgggacaagtcaagatggagtcctatctagtagacacttatcaaggcattccatatacagctgctgttcaagttgacctggtagaaaaagatttactgccagcaagtttgacaatatggtttcctttatttcaggccaacacaccaccagcagttctgcttgatcagctaaaaaccctgacaataaccactctgtatgctgcatcacagaatggtccaatactcaaggtaaatgcatctgcccaaggtgctgccatgtctgtacttcccaaaaaattcgaggtaaatgcaactgtagcacttgatgaatacagtaaacttgattttgacaagctgacggtctgcgatgttaaaacagtttatttgacaactatgaaaccgtacgggatggtgtcaaaatttgtgagttcagccaaatcagttggcaaaaagacacatgatctaattgcactatgtgacttcatggacctagagaaaaatatacctgtgacaataccagcattcataaagtcagtttcaatcaaagagagtgaatcagccactgttgaagctgcaataagcagcgaagccgaccaagccttgacacaagccaagattgcgccctatgcaggactaattatgatcatgaccatgaacaatccaaaaggtatattcaagaaactaggggctggaacacaagtgatagtagagctgggggcatatgttcaggctgagagcatcagtaggatctgcaagagctggagtcaccaaggaacaagatacgtactaaaatccagataaaaataactgtcttaatcaataattgcttatataactctagagattaataagcttattattatagttatataaaaataaattagaattagaagggcatcaatagaaagcgggacaaataaaaatgtcttggaaagtgatgatcatcatttcgttactcataacaccccagcacgggctaaaggagagttatttggaagaatcatgtagtactataactgagggatacctcagtgttttaagaacaggctggtacactaatgtcttcacattagaagttggtgatgttgaaaatcttacatgtactgatggacctagcttaatcaaaacagaacttgatctaacaaaaagtgctttaagggaactcaaaacagtctctgctgatcagttggcgagagaggagcaaattgaaaatcccagacaatcaagatttgtcttaggtgcgatagctctcggagttgctacagcagcagcagtcacagcaggcattgcaatagccaaaaccataaggcttgagagtgaggtgaatgcaattaaaggtgctctcaaacaaactaatgaagcagtatccacattagggaatggtgtgcgggtcctagccactgcagtgagagagctaaaagaatttgtgagcaaaaacctgactagtgcaatcaacaggaacaaatgtgacattgctgatctgaagatggctgtcagcttcagtcaattcaacagaagatttctaaatgttgtgcggcagttttcagacaatgcagggataacaccagcaatatcattggacctgatgactgatgctgagttggccagagctgtatcatacatgccaacatctgcagggcagataaaactgatgttggagaaccgcgcaatggtaaggagaaaaggatttggaatcctgataggggtctacggaagctctgtgatttacatggttcaattgccgatctttggtgtcatagatacaccttgttggatcatcaaggcagctccctcttgctcagaaaaaaacgggaattatgcttgcctcctaagagaggatcaagggtggtattgtaaaaatgcaggatctactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaattgggttggaatcatcaaacaattacccaaaggctgctcatacataaccaaccaggatgcagacactgtaacaattgacaataccgtgtatcaactaagcaaagttgaaggtgaacagcatgtaataaaagggagaccagtttcaagcagttttgatccaatcaagtttcctgaggatcagttcaatgttgcgcttgatcaagtcttcgaaagcattgagaacagtcaggcactagtggaccagtcaaacaaaattctaaacagtgcagaaaaaggaaacactggtttcattatcgtagtaattttggttgctgttcttggtctaaccatgatttcagtgagcatcatcatcataatcaagaaaacaaggaagcccacaggagcacctccagagctgaatggtgtcaccaacggcggtttcataccacatagttagttaattaaaaaatgggacaaatcatcatgtctcgtaaggctccatgcaaatatgaagtgcggggcaaatgcaacagagggagtgattgcaaattcaatcacaattactggagttggcctgatagatatttattgttaagatcaaattatctcttaaatcagcttttaagaaacacagataaggctgatggtttgtcaataatatcaggagcaggtagagaagatagaactcaagactttgttcttggttctactaatgtggttcaagggtacattgatgacaaccaaggaataaccaaggctgcagcttgctatagtctacacaacataatcaagcaactacaagaaacagaagtaagacaggctagagacaacaagctttctgatagcaaacatgtggcgctccacaacttgatattatcctatatggagatgagcaaaactcctgcatctctaatcaacaacctaaagaaactaccaagggaaaaactgaagaaattagcaagattaataattgatttatcagcaggaactgacaatgactcttcatatgccttgcaagacagtgaaagcactaatcaagtgcagtaaacatggtcccaaattcattaccatagaggcagatgatatgatatggactcacaaagaattaaaagaaacactgtctgatgggatagtaaaatcacacaccaatatttatagttgttacttagaaaatatagaaataatatatgttaaaacttacttaagttagtaaaaaataaaaatagaatgggataaatgacaatgaaaacattagatgtcataaaaagtgatggatcctcagaaacgtgtaatcaactcaaaaaaataataaaaaaacactcaggtaaagtgcttattgcactaaaactgatattggccttactgacatttttcacagcaacaatcactgtcaactatataaaagtagaaaacaatttgcaggcatgtcaaccaaaaaatgaatcagacaaaaaggtcacaaagccaaataccacatcaacaacaatcagacccacacccgatccaactgtagtacatcatttgaaaaggctgattcagagacacaccaactctgtcacaaaagacagcgatacttgttggagaatacacaagaatcaacgtacaaatataaaaatatacaagttcttatgctctgggttcacaaattcaaaaggtacagattgtgaggaaccaacagccctatgcgacaaaaagttaaaaaccatagtagaaaaacatagaaaagcagaatgtcactgtctacatacaaccgagtgggggtgccttcatccctaaaataacacggctttcaacattaaaatcagaacaacctccacccaggtctatcaatacagtggtttagccatttaaaaaccgaatattatctaggctgcacgacactttgcaataatatgcaatagtcaatagttaaaccactgctgcaaactcatccataatataatcactgagtaatacaaaatcaagaaaatgggacaagtggctatggaagtaagagtggagaacattcgagcgatagacatgttcaaagcaaagataaaaaaccgtataagaagcagcaggtgctatagaaatgctacactgatccttattggactaacagcgttaagcatggcacttaatattttcctgatcatcgatcatgcaacattaagaaacatgatcaaaacagaaaactgtgctaacatgccgtcggcagaaccaagcaaaaagaccccaatgacctccacagcaggcccaaacaccaaacccaatccacagcaagcaacacagtggaccacagagaactcaacatccccagtagcaaccccagagggccatccatacacagggacaactcaaacatcagacacaacagctccccagcaaaccacagacaaacacacagcaccgctaaaatcaaccaatgaacagatcacccagacaaccacagagaaaaagacaatcagagcaacaacccaaaaaagggaaaaaggaaaagaaaacacaaaccaaaccacaagcacagctgcaacccaaacaaccaacaccaccaaccaaatcagaaatgcaagtgagacaatcacaacatccgacagacccagaactgacaccacaacccaaagcagcgaacagacaacccgggcaacagacccaagctccccaccacaccatgcatagagaggtgcaaaactcaaatgagcacaacacacaaacatcccatccaagtagttaacaaaaaaccacaaaataaccttgaaaaccaaaaaaccaaaacataaacccagacccagaaaaacatagacaccatatggaaggttctagcatatgcaccaatgagatggcatctgttcatgtatcaatagcaccaccatcattcaaggaataagaagaggcgaaaatttaagggataaatgacaatggatcccttttgtgaatctactgttaatgtttatctccctgattcatatctcaaaggagtaatatcttttagtgaaaccaatgcaattggatcatgtcttttgaaaagaccctatctaaaaaatgacaacactgccaaagttgctgtagaaaaccctgttgttgaacatgtgaggcttagaaatgcagtcatgaccaaaatgaagatatcagattataaagtggttgaaccagttaatatgcagcatgaaataatgaaaaatatacatagttgtgagcttacattattaaaacaattcttaacgagaagcaaaaacattagctctctaaaattaaatatgatatgtgattggttacagttaaaatccacttcagataacacatcaattctcaattttatagatgtggagttcatacccgtttgggtaagcaattggttcagtaactggtataatctcaataaattaatcttagagtttagaagagaagaagtaataagaactggttcaattttatgtagatcactaggcaagttagtttttattgtatcatcttatggatgtgtagtaaaaagcaacaaaagtaaaagagtgagctttttcacctataaccaactgttaacatggaaagatgtgatgttaagtagattcaatgcaaacttttgtatatgggtaagtaacaacctgaacaaaaatcaagaaggactaggacttagaagcaatctgcaaggtatgttaaccaataaattatatgaaactgttgattacatgctaagcctatgctgcaatgaaggattctctctggtgaaagagtttgaaggatttattatgagtgaaattctaaaaattactgagcatgctcagttcagtactaggtttaggaatactttattgaatgggttaactgaacaattatcagtgttgaaagctaagaacagatctagagttcttggaactatattagaaaacaacaattaccctatgtacgaagtagtacttaaattattaggggacaccttgaaaagcataaagttattaattaacaagaatttagaaaatgctgcagaattatattatatattcagaatttttggacaccctatggtagatgagagggaagcaatggatgctgttaaattaaacaatgagattacaaaaattcttaaattagagagtttaacagaactaagaggagcatttatactaagaattataaaagggtttgtagacaataataaaagatggcctaaaattaagaatttaaaagtgctcagcaaaagatgggctatgtatttcaaagctaaaagttaccctagccaacttgagctaagtgtacaagattttttagaacttgctgcagtacaatttgagcaggaattctctgtacctgaaaaaaccaaccttgagatggtattaaatgataaagcaatatcacctccaaaaaagctaatatggtctgtatatccaaaaaactacctgcctgaaactataaaaaatcaatatttagaagaggctttcaatgcaagtgacagccaaagaacaaggagagtcttagaattttacttaaaagattgtaaatttgatcaaaaagaacttaaacgttatgtaattaaacaagagtatctgaatgacaaagaccacattgtctcgttaactgggaaggaaagagaattaagtgtaggtaggatgtttgcaatgcaaccaggaaaacaaagacagatacagatattagctgagaaacttctagctgataatattgtaccttttttcccagaaactttaacaaagtatggtgacttagatctccaaagaattatggaaataaaatcagaactttcttccattaaaactagaaagaatgatagctacaacaattatattgcaagggcctctatagtaacagacttaagtaagttcaatcaggcctttagatatgaaaccacagctatatgtgcagatgtagctgatgagttacatgggacacaaagcttattctgttggttacatcttattgttcccatgactacaatgatatgtgcatacagacatgcaccaccagaaacaaaaggggaatatgatatagacaaaatacaagagcaaagcggattatacagatatcatatgggagggattgaagggtggtgccagaagttatggacaatggaagcaatatccttgttagatgtagtatctgtgaagactcgctgtcagatgacctctctattaaacggagacaatcagtcaatagatgttagtaaaccagtaaaattgtctgaaggtatagatgaagtaaaagcagactatagcttagcaattagaatgcttaaagaaataagagatgcttataaaaacattggtcataaactcaaagaaggtgaaacatatatatcaagggatctccaatttataagtaaggtgattcaatctgaaggagtcatgcatcctacccctataaaaaagatattaagagtaggtccttggataaatacaatactagatgatattaaaaccagtgcagaatcaataggaagtctatgtcaagaactagaattcagaggggagagtatactagttagcttgatattaaggaatttctggctgtataacttgtacatgtatgagtcaaaacagcacccattagctgggaagcaactgttcaagcaattgaacaaaacattaacatctgtgcagagattttttgaactgaagaaagaaaatgatgtggttgacctatggatgaatataccaatgcagtttggagggggagatccagtagttttttacagatctttttacagaaggactcccgatttcctaactgaagcaatcagccatgtggatttactgttaaaagtgtcaaacaatatcaaagatgagactaagatacgatttttcaaagccttattatctatagaaaagaatgaacgtgctacattaacaacactaatgagagaccctcaggcagtaggatcagaacgacaagctaaggtaacaagtgatataaatagaacagcagttaccagcatactgagtctatctccgaatcagctcttctgtgatagtgctatacattatagtagaaatgaggaagaagttgggatcattgcagacaacataacacctgtctatcctcatgggctgagagtgctctatgaatcactaccttttcataaggctgaaaaggttgtcaatatgatatcaggcacaaagtctataactaatctattacagagaacatctgctatcaatggtgaagatattgatagagcagtgtctatgatgttagagaacttagggttgttatctagaatattgtcagtaataattaatagtatagaaataccaatcaagtccaatggcagattgatatgctgtcaaatttccaagaccttgagagaaaaatcatggaacaatatggaaatagtaggagtgacatctcctagtattgtgacatgtatggatgttgtgtatgcaactagttctcatttaaaaggaataattattgaaaaattcagtactgacaagaccacaagaggtcagaggggaccaaaaagcccctgggtaggatcaagcactcaagagaaaaaattggttcctgtttataatagacaaattctttcaaaacaacaaaaagagcaactggaagcaatagggaaaatgaggtgggtgtacaaaggaactccagggctaagaagattgctcaacaagatttgcataggaagcttaggtattagctataaatgtgtgaaacctttattaccaagattcatgagtgtaaacttcttacataggttatctgttagtagtagacccatggaattcccagcttctgttccagcttacaggacaacaaattaccattttgacactagtccaatcaaccaagcattaagtgagaggttcgggaacgaagacattaatttagtgttccaaaatgcaatcagctgcggaattagtataatgagtgttgtagaacagttaactggtagaagcccaaaacaattagtcctaatccctcaattagaagagatagatattatgcctcctcctgtatttcaaggaaaattcaattataaactagttgataagataacctccgatcaacacatcttcagtcctgacaaaatagacatattaacactagggaagatgcttatgcctaccataaaaggtcaaaaaactgatcagttcttaaataagagagaaaactattttcatggaaataatttaattgaatctttatctgcagcacttgcatgccactggtgtgggatattaacagaacagtgcatagaaaacaatatctttaggaaagattggggtgatgggttcatctcagatcatgccttcatggatttcaaggtatttctatgtgtatttaaaaccaaacttttatgtagttggggatctcaaggaaagaatgtaaaagatgaagatataatagatgaatccattgacaaattattaagaattgacaacaccttttggagaatgttcagcaaagtcatgtttgaatcaaaagtcaaaaaaagaataatgttatatgatgtgaaattcctatcattagtaggttatataggatttaaaaactggtttatagaacagttaagagtggtagaattgcatgaggtaccttggattgtcaatgctgaaggagagttagttgaaattaaatcaatcaaaatttatctgcagttaatagaacaaagtctatctttgagaataactgtattgaattatacagacatggcacatgctcttacacgattaattaggaaaaaattgatgtgtgataatgcactctttaatccaagttcatcaccaatgtttaatctaactcaggttattgatcccacaacacaactagactattttcctaggataatatttgagaggttaaaaagttatgataccagttcagactacaacaaagggaagttaacaaggaattacatgacattattaccatggcaacacgtaaacaggtacaattttgtctttagttctacaggttgtaaagtcagtttgaagacatgcatcgggaaattgataaaggatttaaatcctaaagttctttactttattggagaaggagcaggtaactggatggcaagaacagcatgtgaatatcctgatataaaatttgtatataggagtttaaaggatgaccttgatcaccattacccattagaatatcaaagggtaataggtgatctaaatagggtgatagatagtggtgaaggattatcaatggaaaccacagatgcaactcaaaaaactcattgggacttgatacacagaataagtaaagatgctttattgataacattgtgtgatgcagaattcaaaaacagagatgatttctttaagatggtaatcctttggagaaaacatgtattatcttgtagaatctgtacagcttatggaacagatctttacttatttgcaaagtatcatgcggtggactgcaatataaaattaccattttttgtaagatctgtagctacttttattatgcaaggaagcaaattatcagggtcagaatgttacatacttttaacattaggtcatcacaataatctaccctgtcatggagaaatacaaaattccaaaatgagaatagcagtgtgtaatgatttctatgcctcaaagaaactggacaacaaatcaattgaagcaaactgcaaatctcttctatcaggattgagaatacctataaacaaaaaggagttaaatagacaaaagaaattgttaacactacaaagtaaccattcttctatagcaacagttggcggcagtaagattatagaatccaaatggttaaagaataaagcaagtacaataattgattggttagagcatattttgaattctccaaaaggtgaattaaactatgatttctttgaagcattagagaacacataccccaatatgatcaagcttatagataatttgggaaatgcagaaataaagaaactaatcaaggtcactgggtatatgcttgtgagtaagaagtaataataatgataatgattaaccataatctcacacaactgagaaaataatcgtctaacagtttagttgatcattagttatttaaaattataaaatagtaactaactgataaaaaatcagaaattgaaattgaatgtatacggtttttttgccgt

SEQ ID NO: 19 - DNA, 13350 bp, human metapneumo virus
gtataaattagattccaaaaaaatatgggacaagtgaaaatgtctcttcaagggattcacctgagtgatttatcatacaagcatgctatattaaaagagtctcagtacacaataaaaagagatgtgggtacaacaactgcagtgacaccctcatcattgcaacaagaaataacactgttgtgtggagaaattctgtatgctaaacatgctgactacaaatatgctgcagaaataggaatacaatatattagcacagctttaggatcagagagagtgcagcagattctgaggaactcaggcagtgaagtccaagtggtcttaaccagaacgtactctctggggaaaattaaaaacaataaaggagaagatttacagatgttagacatacacggggtagagaagagctgggtagaagagatagacaaagaagcaaggaaaacaatggcaaccttgcttaaggaatcatcaggtaatatcccacaaaatcagaggccctcagcaccagacacacccataatcttattatgtgtaggtgccttaatattcactaaactagcatcaaccatagaagtgggactagagaccacagtcagaagggctaaccgtgtactaagtgatgcactcaagagataccctagaatggacataccaaagattgccagatccttctatgacttatttgaacaaaaagtgtatcacagaagtttgttcattgagtatggcaaagcattaggctcatcatctacaggcagcaaagcagaaagtctatttgttaatatattcatgcaagcttatggggccggtcaaacaatgctaaggtggggggtcattgccaggtcatccaacaatataatgttaggacatgtatccgtccaagctgagttaaaacaggtcacagaagtctatgacttggtgcgagaaatgggccctgaatctggacttctacatttaaggcaaagcccaaaagctggactgttatcactagccaactgtcccaactttgcaagtgttgttctcggaaatgcctcaggcttaggcataatcggtatgtatcgagggagagtaccaaacacagaattattttcagcagctgaaagttatgccaaaagtttgaaagaaagcaataaaataaatttctcttcattaggacttacagatgaagagaaagaggctgcagaacatttcttaaatgtgagtgacgacagtcaaaatgattatgagtaattaaaaaagtgggacaagtcaaaatgtcattccctgaaggaaaagatattcttttcatgggtaatgaagcagcaaaattagcagaagctttccagaaatcattaagaaaaccaggtcataaaagatctcaatctattataggagaaaaagtgaatactgtatcagaaacattggaattacctactatcagtagacctgcaaaaccaaccataccgtcagaaccaaagttagcatggacagataaaggtggggcaaccaaaactgaaataaagcaagcaatcaaagtcatggatcccattgaagaagaagagtctaccgagaagaaggtgctaccctccagtgatgggaaaacccctgcagaaaagaaactgaaaccatcaactaacaccaaaaagaaggtttcatttacaccaaatgaaccagggaaatatacaaagttggaaaaagatgctctagatttgctctcagataatgaagaagaagatgcagaatcttcaatcttaacctttgaagaaagagatacttcatcattaagcattgaggccagattggaatcaatagaggagaaattaagcatgatattagggctattaagaacactcaacattgctacagcaggacccacagcagcaagagatgggatcagagatgcaatgattggcgtaagagaggaattaatagcagacataataaaggaagctaaagggaaagcagcagaaatgatggaagaggaaatgagtcaacgatcaaaaataggaaatggtagtgtaaaattaacagaaaaagcaaaagagctcaacaaaattgttgaagatgaaagcacaagtggagaatccgaagaagaagaagaaccaaaagacacacaagacaatagtcaagaagatgacatttaccagttaattatgtagtttaataaaaataaacaatgggacaagtaaaaatggagtcctacctagtagacacctatcaaggcattccttacacagcagctgttcaagttgatctaatagaaaaggacctgttacctgcaagcctaacaatatggttccctttgtttcaggccaacacaccaccagcagtgctgctcgatcagctaaaaaccctgacaataaccactctgtatgctgcatcacaaaatggtccaatactcaaagtgaatgcatcagcccaaggtgcagcaatgtctgtacttcccaaaaaatttgaagtcaatgcgactgtagcactcgatgaatatagcaaactggaatttgacaaactcacagtctgtgaagtaaaaacagtttacttaacaaccatgaaaccatacgggatggtatcaaaatttgtgagctcagccaaatcagttggcaaaaaaacacatgatctaatcgcactatgtgattttatggatctagaaaagaacacacctgttacaataccagcattcatcaaatcagtttcaatcaaagagagtgagtcagctactgttgaagctgctataagcagtgaagcagaccaagctctaacacaggccaaaattgcaccttatgcgggattaattatgatcatgactatgaacaatcccaaaggcatattcaaaaagcttggagctgggactcaagtcatagtagaactaggagcatatgtccaggctgaaagcataagcaaaatatgcaagacttggagccatcaagggacaagatatgtcttgaagtccagataacaaccaagcaccttggccaagagctactaaccctatctcatagatcataaagtcaccattctagttatataaaaatcaagttagaacaagaattaaatcaatcaagaacgggacaaataaaaatgtcttggaaagtggtgatcattttttcattgttaataacacctcaacacggtcttaaagagagctacttagaagagtcatgtagcactataactgaaggatatctcagtgttctgaggacaggttggtacaccaatgtttttacactggaggtaggcgatgtagagaaccttacatgtgccgatggacccagcttaataaaaacagaattagacctgaccaaaagtgcactaagagagctcagaacagtttctgctgatcaactggcaagagaggagcaaattgaaaatcccagacaatctagattcgttctaggagcaatagcactcggtgttgcaactgcagctgcagttacagcaggtgttgcaattgccaaaaccatccggcttgaaagtgaagtaacagcaattaagaatgccctcaaaaagaccaatgaagcagtatctacattggggaatggagttcgtgtgttggcaactgcagtgagagagctgaaagattttgtgagcaagaatctaacacgtgcaatcaacaaaaacaagtgcgacattgctgacctgaaaatggccgttagcttcagtcaattcaacagaaggttcctaaatgttgtgcggcaattttcagacaacgctggaataacaccagcaatatctttggacttaatgacagatgctgaactagccagagctgtttccaacatgccaacatctgcaggacaaataaaactgatgttggagaaccgtgcaatggtaagaagaaaagggttcggattcctgataggagtttacggaagctccgtaatttacatggtgcaactgccaatctttggggttatagacacgccttgctggatagtaaaagcagccccttcttgttcaggaaaaaagggaaactatgcttgcctcttaagagaagaccaaggatggtattgtcaaaatgcagggtcaactgtttactacccaaatgaaaaagactgtgaaacaagaggagaccatgtcttttgcgacacagcagcaggaatcaatgttgctgagcagtcaaaggagtgcaacataaacatatctactactaattacccatgcaaagttagcacaggaagacatcctatcagtatggttgcactatctcctcttggggctttggttgcttgctacaagggagtgagctgttccattggcagcaacagagtagggatcatcaagcaactgaacaaaggctgctcttatataaccaaccaagacgcagacacagtgacaatagacaacactgtataccagctaagcaaagttgaaggcgaacagcatgttataaaaggaaggccagtgtcaagcagctttgacccagtcaagtttcctgaagatcaattcaatgttgcacttgaccaagttttcgagagcattgagaacagtcaggccttggtggatcaatcaaacagaatcctaagcagtgcagagaaaggaaacactggcttcatcattgtaataattctaattgctgtccttggctctaccatgatcctagtgagtgtttttatcataataaagaaaacaaagaaacccacaggagcacctccagagctgagtggtgtcacaaacaatggcttcataccacataattagttaattaaaaataaagtaaattaaaataaattaaaattaaaaataaaaatttgggacaaatcataatgtctcgcaaggctccgtgcaaatatgaagtgcggggcaaatgcaatagaggaagtgagtgcaagtttaaccacaattactggagttggccagatagatacttattaataagatcaaattatttattaaatcaacttttaaggaacactgatagagctgatggcttatcaataatatcaggagcaggcagagaagataggacacaagattttgtcctaggttccaccaatgtggttcaaggttatattgatgataaccaaagcataacaaaagctgcagcctgttacagtctacataatataatcaaacaactacaagaagttgaagttaggcaggctagagataacaaactatctgacagcaaacatgtagcacttcacaacttagtcctatcttatatggagatgagcaaaactcctgcatctttaatcaacaatctcaagagactgccgagagagaaactgaaaaaattagcaaagctcataattgacttatcagcaggtgctgaaaatgactcttcatatgccttgcaagacagtgaaagcactaatcaagtgcagtgagcatggtccagttttcattactatagaggttgatgacatgatatggactcacaaggacttaaaagaagctttatctgatgggatagtgaagtctcatactaacatttacaattgttatttagaaaacatagaaattatatatgtcaaggcttacttaagttagtaaaaacacatcagagtgggataaatgacaatgataacattagatgtcattaaaagtgatgggtcttcaaaaacatgtactcacctcaaaaaaataattaaagaccactctggtaaagtgcttattgtacttaagttaatattagctttactaacatttctcacagtaacaatcaccatcaattatataaaagtggaaaacaatctgcaaatatgccagtcaaaaactgaatcagacaaaaaggactcatcatcaaataccacatcagtcacaaccaagactactctaaatcatgatatcacacagtattttaaaagtttgattcaaaggtatacaaactctgcaataaacagtgacacatgctggaaaataaacagaaatcaatgcacaaatataacaacatacaaatttttatgttttaaatctgaagacacaaaaaccaacaattgtgataaactgacagatttatgcagaaacaaaccaaaaccagcagttggagtgtatcacatagtagaatgccattgtatatacacagttaaatggaagtgctatcattacccaaccgatgaaacccaatcctaaatgttaacaccagattaggatccatccaagtctgttagttcaacaatttagttatttaaaaatattttgaaaacaagtaagtttctatgatacttcataataataagtaataattaattgcttaatcatcatcacaacattattcgaaaccataactattcaatttaaaaagtaaaaaacaataacatgggacaagtagttatggaggtgaaagtggagaacattcgaacaatagatatgctcaaagcaagagtaaaaaatcgtgtggcacgcagcaaatgctttaaaaatgcctctttggtcctcataggaataactacattgagtattgccctcaatatctatctgatcataaactataaaatgcaaaaaaacacatctgaatcagaacatcacaccagctcatcacccatggaatccagcagagaaactccaacggtccccacagacaactcagacaccaactcaagcccacagcatccaactcaacagtccacagaaggctccacactctactttgcagcctcagcaagctcaccagagacagaaccaacatcaacaccagatacaacaaaccgcccgcccttcgtcgacacacacacaacaccaccaagcgcaagcagaacaaagacaagtccggcagtccacacaaaaaacaacccaaggacaagctctagaacacattctccaccacgggcaacgacaaggacggcacgcagaaccaccactctccgcacaagcagcacaagaaagagaccgtccacagcatcagtccaacctgacatcagcgcaacaacccacaaaaacgaagaagcaagtccagcgagcccacaaacatctgcaagcacaacaagaatacaaaggaaaagcgtggaggccaacacatcaacaacatacaaccaaactagttaacaaaaaatacaaaataactctaagataaaccatgcagacaccaacaatggagaagccaaaagacaattcacaatctccccaaaaaggcaacaacaccatattagctctgcccaaatctccctggaaaaaacactcgcccatataccaaaaataccacaaccaccccaagaaaaaaactgggcaaaacaacacccaagagacaaataacaatggatcctctcaatgaatccactgttaatgtctatcttcctgactcatatcttaaaggagtgatttcctttagtgagactaatgcaattggttcatgtctcttaaaaagaccttacctaaaaaatgacaacactgcaaaagttgccatagagaatcctgttatcgagcatgttagactcaaaaatgcagtcaattctaagatgaaaatatcagattacaagatagtagagccagtaaacatgcaacatgaaattatgaagaatgtacacagttgtgagctcacattattaaaacagtttttaacaaggagtaaaaatattagcactctcaaattaaatatgatatgtgattggctgcagttaaagtctacatcagatgatacctcaatcctaagttttatagatgtagaatttatacctagctgggtaagcaattggtttagtaattggtacaatctcaacaagttgattctggaattcaggaaagaagaagtaataagaactggttcaatcttgtgtaggtcattgggtaaattagtttttgttgtatcatcatatggatgtatagtcaagagcaacaaaagcaaaagagtgagcttcttcacatacaatcaactgttaacatggaaagatgtgatgttaagtagattcaatgcaaatttttgtatatgggtaagcaacagtctgaatgaaaatcaagaagggctagggttgagaagtaatctgcaaggcatattaactaataagctatatgaaactgtagattatatgcttagtttatgttgcaatgaaggtttctcacttgtgaaagagttcgaaggctttattatgagtgaaattcttaggattactgaacatgctcaattcagtactagatttagaaatactttattaaatggattaactgatcaattaacaaaattaaaaaataaaaacagactcagagttcatggtaccgtgttagaaaataatgattatccaatgtacgaagttgtacttaagttattaggagatactttgagatgtattaaattattaatcaataaaaacttagagaatgctgctgaattatactatatatttagaatattcggtcacccaatggtagatgaaagagatgcaatggatgctgtcaaattaaacaatgaaatcacaaaaatccttaggtgggagagcttgacagaactaagaggggcattcatattaaggattatcaaaggatttgtagacaacaacaaaagatggcccaaaattaaaaacttaaaagtgcttagtaagagatggactatgtacttcaaagcaaaaagttaccccagtcaacttgaattaagcgaacaagattttttagagcttgctgcaatacagtttgaacaagagttttctgtccctgaaaaaaccaaccttgagatggtattaaatgataaagctatatcacctcctaaaagattaatatggtctgtgtatccaaaaaattacttacctgagaaaataaaaaatcgatatctagaagagactttcaatgcaagtgatagtctcaaaacaagaagagtactagagtactatttgaaagataataaattcgaccaaaaagaacttaaaagttatgttgttaaacaagaatatttaaatgataaggatcatattgtctcgctaactggaaaagaaagagaattaagtgtaggtagaatgtttgctatgcaaccaggaaaacagcgacaaatacaaatattggctgaaaaattgttagctgataatattgtaccttttttcccagaaaccttaacaaagtatggtgatctagatcttcagagaataatggaaatcaaatcggaactttcttctattaaaactagaagaaatgatagttataataattacattgcaagagcatccatagtaacagatttaagtaagttcaaccaagcctttaggtatgaaactacagcgatctgtgcggatgtagcagatgaactacatggaacacaaagcctattctgttggttacatcttatcgtccctatgacaacaatgatatgtgcctatagacatgcaccaccagaaacaaaaggtgaatatgatatagataagatagaagagcaaagtggtttatatagatatcatatgggtggtattgaaggatggtgtcaaaaactctggacaatggaagctatatctctattagatgttgtatctgtaaaaacacgatgtcaaatgacatctttattaaacggtgacaaccaatcaatagatgtaagtaaaccagttaagttatctgagggtttagatgaagtgaaagcagattatagcttggctgtaaaaatgttaaaagaaataagagatgcatacagaaatataggccataaacttaaagaaggggaaacatatatatcaagagatcttcagtttataagtaaggtgattcaatctgaaggagtaatgcatcctacccctataaaaaagatcttaagagtgggaccatggataaacacaatattagatgacattaaaaccagtgcagagtcaatagggagtctatgtcaggaattagaatttaggggggaaagcataatagttagtctgatattaaggaatttttggctgtataatttatacatgcatgaatcaaagcaacaccccctagcagggaagcagttattcaaacaactaaataaaacattaacatcagtgcagagattttttgaaataaaaaaggaaaatgaagtagtagatctatggatgaacataccaatgcagtttggaggaggagatccagtagtcttctatagatctttctatagaaggacccctgattttttaactgaagcaatcagtcatgtggatattctgttaagaatatcagccaacataagaaatgaagcgaaaataagtttcttcaaagccttactgtcaatagaaaaaaatgaacgtgctacactgacaacactaatgagagatcctcaagctgttggctcagagcgacaagcaaaagtaacaagtgatatcaatagaacagcagttaccagcatcttaagtctttctccaaatcaacttttcagcgatagtgctatacactacagtagaaatgaagaagaggtcggaatcattgctgacaacataacacctgtttatcctcatggactgagagttttgtatgaatcattaccttttcataaagctgaaaaagttgtgaatatgatatcaggaacgaaatccataaccaacttattacagagaacatctgctattaatggtgaagatattgacagagctgtatccatgatgctggagaacctaggattattatctagaatattgtcagtagttgttgatagtatagaaattccaaccaaatctaatggtaggctgatatgttgtcagatatctagaaccctaagggagacatcatggaataatatggaaatagttggagtaacatcccctagcatcactacatgcatggatgtcatatatgcaactagctctcatttgaaagggataatcattgaaaagttcagcactgacagaactacaagaggtcaaagaggtccaaagagcccttgggtagggtcgagcactcaagagaaaaaattagttcctgtttataacagacaaattctttcaaaacaacaaagagaacagctagaagcaattggaaaaatgagatgggtatataaagggacaccaggtttaagacgattactcaataagatttgtcttggaagtttaggcattagttacaaatgtgtaaaacctttattacctaggtttatgagtgtaaatttcctacacaggttatctgtcagtagtagacctatggaattcccagcatcagttccagcttatagaacaacaaattaccattttgacactagtcctattaatcaagcactaagtgagagatttgggaatgaagatattaatttggtcttccaaaatgcaatcagctgtggaattagcataatgagtgtagtagaacaattaactggtaggagtccaaaacagttagttttaatacctcaattagaagaaatagacattatgccaccaccagtgtttcaagggaaattcaattataagctagtagataagataacttctgatcaacatatcttcagtccagacaaaatagatatgttaacactggggaaaatgctcatgcccactataaaaggtcagaaaacagatcagttcctgaacaagagagagaattatttccatgggaataatcttattgagtctttgtcagcagcgttagcatgtcattggtgtgggatattaacagagcaatgtatagaaaataatattttcaagaaagactggggtgacgggttcatatcggatcatgcttttatggacttcaaaatattcctatgtgtctttaaaactaaacttttatgtagttgggggtcccaagggaaaaacattaaagatgaagatatagtagatgaatcaatagataaactgttaaggattgataatactttttggagaatgttcagcaaggttatgtttgaatcaaaggttaagaaaaggataatgttatatgatgtaaaatttctatcattagtaggttatatagggtttaagaattggtttatagaacagttgagatcagctgagttgcatgaggtaccttggattgtcaatgccgaaggtgatctggttgagatcaagtcaattaaaatctatttgcaactgatagagcaaagtttatttttaagaataactgttttgaactatacagatatggcacatgctctcacaagattaatcagaaagaagttgatgtgtgataatgcactattaactccgattccatccccaatggttaatttaactcaagttattgatcctacagaacaattagcttatttccctaagataacatttgaaaggctaaaaaattatgacactagttcaaattatgctaaaggaaagctaacaaggaattacatgatactgttgccatggcaacatgttaatagatataactttgtctttagttctactggatgtaaagttagtctaaaaacatgcattggaaaacttatgaaagatctaaaccctaaagttctgtactttattggagaaggggcaggaaattggatggccagaacagcatgtgaatatcctgacatcaaatttgtatacagaagtttaaaagatgaccttgatcatcattatcctttggaataccagagagttataggagaattaagcaggataatagatagcggtgaagggctttcaatggaaacaacagatgcaactcaaaaaactcattgggatttgatacacagagtaagcaaagatgctttattaataactttatgtgatgcagaatttaaggacagagatgatttttttaagatggtaattctatggaggaaacatgtattatcatgcagaatttgcactacttatgggacagacctctatttattcgcaaagtatcatgctaaagactgcaatgtaaaattacctttttttgtgagatcagtagccacctttattatgcaaggtagtaaactgtcaggctcagaatgctacatactcttaacactaggccaccacaacaatttaccctgccatggagaaatacaaaattctaagatgaaaatagcagtgtgtaatgatttttatgctgcaaaaaaacttgacaataaatctattgaagccaactgtaaatcacttttatcagggctaagaataccgataaataagaaagaattaaatagacagagaaggttattaacactacaaagcaaccattcttctgtagcaacagttggaggtagcaaggtcatagagtctaaatggttaacaaacaaggcaaacacaataattgattggttagaacatattttaaattctccaaaaggtgaattaaattatgatttttttgaagcattagaaaatacttaccctaatatgattaaactaatagataatctagggaatgcagagataaaaaaactgatcaaagtaactggatatatgcttgtaagtaaaaaatgaaaaatgataaaaatgataaaataggtgacaacttcatactattccaaagtaatcatttgattatgcaattatgtaatagttaattaaaaactaaaaatcaaaagttagaaactaacaactgtcattaagtttattaaaaataagaaattataattggatgtatacg

SEQ ID NO: 20 - DNA, 13215 bp, human metapneumo virus
acgcgaaaaaaacgcgtataaattaagttacaaaaaaccatgggacaagtgaaaatgtctcttcaagggattcacctgagtgatctatcatacaagcatgctatattaaaagagtctcagtatacaataaagagagatgtaggcacaacaaccgcagtgacaccctcatcattgcaacaagaaataacactattgtgtggagaaattctatatgctaagcatgctgattacaaatatgctgcagaaataggaatacaatatattagcacagctctaggatcagagagagtacagcagattctaagaaactcaggtagtgaagtccaagtggttttaaccagaacgtactccttggggaaagttaaaaacaacaaaggagaagatttacagatgttagacatacacggagtagagaaaagctgggtggaagagatagacaaagaagcaagaaaaacaatggcaactttgcttaaagaatcatcaggcaatattccacaaaatcagaggccttcagcaccagacacacccataatcttattatgtgtaggtgccttaatatttaccaaactagcatcaactatagaagtgggattagagaccacagtcagaagagctaaccgtgtactaagtgatgcactcaaaagataccctaggatggacataccaaaaatcgctagatctttctatgacttatttgaacaaaaagtgtattacagaagtttgttcattgagtatggcaaagcattaggctcatcctctacaggcagcaaagcagaaagtttattcgttaatatattcatgcaagcttacggtgctggtcaaacaatgctgaggtggggagtcattgccaggtcatctaacaatataatgttaggacatgtatctgttcaagctgagttaaaacaagtcacagaagtctatgacctggtgcgagaaatgggccctgaatctgggctcctacatttaaggcaaagcccaaaagctggactgttatcactagccaattgtcccaactttgctagtgttgttctcggcaatgcctcaggcttaggcataataggtatgtatcgcgggagagtgccaaacacagaactattttcagcagcagaaagctatgccaagagtttgaaagaaagcaataaaattaacttttcttcattaggactcacagatgaagaaaaagaggctgcagaacacttcctaaatgtgagtgacgacagtcaaaatgattatgagtaattaaaaaaatgggacaagtcaaaatgtcattccctgaaggaaaagatattcttttcatgggtaatgaagcagcaaaattggcagaagcttttcaaaaatcattaagaaaacctaatcataaaagatctcaatctattataggagaaaaagtgaacactgtatctgaaacattggaattacctactatcagtagacctaccaaaccgaccatattgtcagagccgaagttagcatggacagacaaaggtggggcaatcaaaactgaagcaaagcaaacaatcaaagttatggatcctattgaagaagaagagtttactgagaaaagggtgctgccctccagtgatgggaaaactcctgcagaaaagaagttgaaaccatcaaccaacactaaaaagaaggtctcatttacaccaaatgaaccaggaaaatacacaaagttggagaaagatgctctagacttgctttcagacaatgaagaagaagatgcagaatcctcaatcttaaccttcgaagaaagagatacttcatcattaagcattgaagccagactagaatcgattgaggagaaattaagcatgatattagggctattaagaacactcaacattgctacagcaggacccacagcagcaagagatgggatcagagatgcaatgattggcataagggaggaactaatagcagacataataaaagaagccaagggaaaagcagcagaaatgatggaagaagaaatgaaccagcggacaaaaataggaaacggtagtgtaaaattaactgaaaaggcaaaggagctcaacaaaattgttgaagacgaaagcacaagtggtgaatccgaagaagaagaagaaccaaaagacacacaggaaaataatcaagaagatgacatttaccagttaattatgtagtttaataaaaataaaaatgggacaagtgaaaatggagtcctatctggtagacacttatcaaggcatcccttacacagcagctgttcaagttgatctagtagaaaaggacctgttacctgcaagcctaacaatatggttccccttgtttcaggccaatacaccaccagcagttctgcttgatcagctaaagactctgactataactactctgtatgctgcatcacaaagtggtccaatactaaaagtgaatgcatcagcccagggtgcagcaatgtctgtacttcccaaaaagtttgaagtcaatgcgactgtagcacttgacgaatatagcaaattagaatttgacaaacttacagtctgtgaagtaaaaacagtttacttaacaaccatgaaaccatatgggatggtatcaaagtttgtgagctcggccaaatcagttggcaaaaaaacacatgatctaatcgcattatgtgattttatggatctagaaaagaacacaccagttacaataccagcatttatcaaatcagtttctatcaaggagagtgaatcagccactgttgaagctgcaataagcagtgaagcagaccaagctctaacacaagccaaaattgcaccttatgcgggactgatcatgattatgaccatgaacaatcccaaaggcatattcaagaagcttggagctgggacccaagttatagtagaactaggagcatatgtccaggctgaaagcataagtaaaatatgcaagacttggagccatcaaggaacaagatatgtgctgaagtccagttaacagccaagcaacctggccaagaactaccaactctattctatagactaaaaagtcgccattttagttatataaaaatcaagttagaataagaattaaatcaatcaagaacgggacaaataaaaatgtcttggaaagtggtgatcattttttcattgctaataacacctcaacacggtcttaaagagagctacctagaagaatcatgtagcactataactgagggatatcttagtgttctgaggacaggttggtataccaacgtttttacattagaggtgggtgatgtagaaaaccttacatgttctgatggacctagcctaataaaaacagaattagatctgaccaaaagtgcactaagagagctcaaaacagtctctgctgaccaattggcaagagaggaacaaattgagaatcccagacaatctaggtttgttctaggagcaatagcactcggtgttgcaacagcagctgcagtcacagcaggtgttgcaattgccaaaaccatccggcttgagagtgaagtcacagcaattaagaatgccctcaaaacgaccaatgaagcagtatctacattggggaatggagttcgagtgttggcaactgcagtgagagagctaaaagactttgtgagcaagaatttaactcgtgcaatcaacaaaaacaagtgcgacattgatgacctaaaaatggctgttagcttcagtcaattcaacagaaggtttctaaatgttgtgcggcaattttcagacaatgctggaataacaccagcaatatctttggacttaatgacagatgctgaactagccagggccgtttctaacatgccgacatctgcaggacaaataaaattgatgttggagaaccgtgcgatggtgcgaagaaaggggttcggaatcctgataggggtctacgggagctccgtaatttacacggtgcagctgccaatctttggcgttatagacacgccttgctggatagtaaaagcagccccttcttgttccgaaaaaaagggaaactatgcttgcctcttaagagaagaccaagggtggtattgtcagaatgcagggtcaactgtttactacccaaatgagaaagactgtgaaacaagaggagaccatgtcttttgcgacacagcagcaggaattaatgttgctgagcaatcaaaggagtgcaacatcaacatatccactacaaattacccatgcaaagtcagcacaggaagacatcctatcagtatggttgcactgtctcctcttggggctctggttgcttgctacaaaggagtaagctgttccattggcagcaacagagtagggatcatcaagcagctgaacaaaggttgctcctatataaccaaccaagatgcagacacagtgacaatagacaacactgtatatcagctaagcaaagttgagggtgaacagcatgttataaaaggcagaccagtgtcaagcagctttgatccaatcaagtttcctgaagatcaattcaatgttgcacttgaccaagtttttgagaacattgaaaacagccaggccttagtagatcaatcaaacagaatcctaagcagtgcagagaaagggaatactggctttatcattgtaataattctaattgctgtccttggctctagcatgatcctagtgagcatcttcattataatcaagaaaacaaagaaaccaacgggagcacctccagagctgagtggtgtcacaaacaatggcttcataccacacagttagttaattaaaaataaaataaaatttgggacaaatcataatgtctcgcaaggctccatgcaaatatgaagtgcggggcaaatgcaacagaggaagtgagtgtaagtttaaccacaattactggagttggccagatagatacttattaataagatcaaactatctattaaatcagcttttaaggaacactgatagagctgatggcctatcaataatatcaggcgcaggcagagaagacagaacgcaagattttgttctaggttccaccaatgtggttcaaggttatattgatgataaccaaagcataacaaaagctgcagcctgctacagtctacacaacataatcaagcaactacaagaagttgaagttaggcaggctagagatagcaaactatctgacagcaagcatgtggcactccataacttaatcttatcttacatggagatgagcaaaactcccgcatctttaatcaacaatcttaaaagactgccgagagaaaaactgaaaaaattagcaaagctgataattgacttatcagcaggcgctgacaatgactcttcatatgccctgcaagacagtgaaagcactaatcaagtgcagtgagcatggtcctgttttcattactatagaggttgatgaaatgatatggactcaaaaagaattaaaagaagctttgtccgatgggatagtgaagtctcacaccaacatttacaattgttatttagaaaacatagaaattatatatgtcaaggcttacttaagttagtaaaaacacacatcagagtgggataagtgacaatgataacattagatgtcattaaaagtgatgggtcttcaaaaacatgtactcacctcaaaaaaataatcaaagaccattctggtaaagtgcttattgcacttaagttaatattagctttactaacatttttcacaataacaatcactataaattacataaaagtagaaaacaatctacaaatatgccagtcaaaaactgaatcagacaaagaagactcaccatcaaataccacatccgtcacaaccaagactactctagaccatgatataacacagtattttaaaagattaattcaaaggtatacagattctgtgataaacaaggacacatgctggaaaataagcagaaatcaatgcacaaatataacaacatataaatttttatgctttaaacctgaggactcaaaaatcaacagttgtgatagactgacagatctatgcagaaacaaatcaaaatcagcagctgaagcatatcatacagtagaatgccattgcatatacacaattgagtggaagtgctatcaccacccaatagattaaacccaattttgaatgttaaaactagactaggatccgtctaagactatcagttcaatagtttagttatttaaaaatatttgagaacaggtaagtttctatggcacttcatagcaataggtaataattaacagcttaattataattaaaacattatttaaaaccgtaactatttaatttacaaagtaaaaacaaaaatatgggacaagtagttatggaggtgaaagtagagaacattcgagcaatagacatgctcaaagcaagagtgaaaaatcgtgtggcacgtagcaaatgctttaaaaatgcttctttaatcctcataggaataactacactgagtatagctctcaatatctatctgatcataaactacacaatacaaaaaaccacatccgaatcagaacaccacaccagctcaccacccacagaacccaacaaggaagcttcaacaatctccacagacaacccagacatcaatccaagctcacagcatccaactcaacagtccacagaaaaccccacactcaaccccgcagcatcagcgagcccatcagaaacagaaccagcatcaacaccagacacaacaaaccgcctgtcctccgtagacaggtccacagcacaaccaagtgaaagcagaacaaagacaaaaccgacagtccacacaatcaacaacccaaacacagcttccagtacacaatccccaccacggacaacaacgaaggcaatccgcagagccaccactttccgcatgagcagcacaggaaaaagaccaaccacaacattagtccagtccgacagcagcaccacaacccaaaatcatgaagaaacaggttcagcgaacccacaggcgtctgcaagcacaatgcaaaactagcacaccaataatataaaaccaaattagttaacaaaaaatgcgagatagctctaaagcaaaacatgtaggtaccaacaatcaagaaaccaaaagacaactcacaatctccctaaaacagcaacgacaccatgtcagctttgctcaaatctctctgggagaaacttctacccacatactaacaacatcacaaccatctcaagaaaagaaactgggcaaaacagcatccaagagacaaatagcaatggatcctcttaatgaatccactgttaatgtctatctccctgattcgtaccttaaaggagtaatttcttttagtgaaactaatgcaattggttcatgtctcttaaaaagaccttacttaaaaaatgacaacactgcaaaagttgccatagagaatcctgttattgagcatgtgagactcaaaaatgcagtcaattctaaaatgaaaatatcagattacaaggtagtagagccagtaaacatgcaacatgaaataatgaagaatgtacacagttgtgagctcacactattgaaacagtttttaacaaggagtaaaaacattagcactctcaaattaaatatgatatgtgattggctgcaattaaagtctacatcagatgatacctcaatcctaagtttcatagatgtagaatttatacctagttgggtaagcaactggtttagtaattggtacaatctcaataagttaattttggaattcagaagagaggaagtaataagaaccggttcaatcttatgcaggtcattgggtaaattagtttttattgtatcatcatacggatgtatcgtcaagagcaacaaaagcaaaagagtgagcttcttcacatacaatcaactgttaacatggaaagatgtgatgttaagtagatttaatgcgaatttttgtatatgggtaagcaatagtctgaatgaaaatcaggaagggctagggttaagaagtaatctacaaggtatgttaactaataaactatatgaaactgtagattatatgctaagtttatgttgcaatgaaggtttctcacttgtaaaagagttcgaaggttttattatgagtgaaatccttaggattactgaacatgctcaattcagtactagatttagaaatactttattaaatggattaacagatcaattaacaaaattaaaaaataaaaacagactcagagttcatggtaccgtattagaaaataatgattatccaatgtatgaagttgtacttaaattattaggagatactttgagatgtatcaaattattaatcaataaaaacttagagaatgctgcagaattatactatatattcagaatttttggtcatccaatggtagatgaaagagatgcaatggatgctgtcaaattaaacaatgaaatcacaaaaatcctaaggttggagagcttgacagaactaagaggagcattcatattaaggattatcaaaggatttgtggacaacaacaaaaggtggcccaaaattaaaaatttaatagtgcttagcaaaagatggactatgtacttcaaagctaaaaattatcccagtcaactcgaattaagtgaacaagactttctagagcttgctgcaatacaatttgaacaagagttttctgttcctgaaaaaaccaatcttgagatggtattaaatgacaaagccatatcacctcctaaaagattaatatggtctgtgtatccaaagaattacttacctgagacgataaaaaatcgatatttagaagaaactttcaatgcgagtgatagtctcaaaacaagaagagtactagagtactatttaaaagacaataaatttgatcaaaaggaacttaaaagttatgtagttagacaagaatatttaaatgataaggagcacattgtctcattaactggaaaagaaagagaattaagtgtaggtagaatgtttgctatgcaaccaggaaaacagcgacaaatacaaatattggcagaaaaattgttagctgataacattgtacctttcttcccggaaaccttaacaaagtatggtgatctagatcttcagagaataatggaaatcaaatcagaactttcttctatcaaaaccagaagaaatgacagttataataattacattgcaagagcatccatagtaacagatttgagcaagttcaaccaagcctttagatatgaaactacagcgatctgtgcggatgtagcagacgaattacatggaacacaaagcttattctgttggttacatcttatcgttcctatgactacaatgatatgtgcctatagacatgcaccaccagaaacaaaaggtgaatatgatatagataagatagaagagcaaagtggtctatatagatatcacatgggcggtattgaaggatggtgtcaaaaactctggacaatggaagctatatctttattggatgttgtatctgtaaagacacggtgtcaaatgacatctttattaaacggtgataaccaatcaatagatgtaagtaaaccagtcaagttatctgaaggtttagatgaagtgaaggcagattatcgcttagcaataaaaatgctaaaagaaataagagatgcatacagaaatataggccataaacttaaagaaggggaaacatatatatcaagggatcttcaatttataagcaaggtgattcaatctgaaggagtgatgcatcctacccctataaaaaaggtcttgagagtaggaccatggataaacacaatattagatgacattaaaactagtgctgagtcaatagggagtctatgtcaagaattagaatttaggggagaaagcataatagttagtctgatattaagaaacttctggctgtataacttatacatgcatgaatcaaagcaacatcctttggcagggaaacagttattcaaacaactaaataaaacattaacatcagtgcagagattttttgaaattaaaaaggaaaatgaggtagtagatctatggatgaacataccaatgcaatttggaggaggagatccagtagtcttctatagatctttctatagaaggacccctgattttttaactgaggcaatcagccatgtagatattctgttaaaaatatcagctaacataaaaaatgaaacgaaagtaagtttcttcaaagccttactatcaatagaaaaaaatgaacgtgctacactgacaacgctaatgagagatcctcaagctgttggatcagaacgacaagcaaaagtaacaagtgacatcaatagaacagcagttaccagtatcttaagtctttccccaaatcaacttttcagtgatagtgctatacactatagcaggaatgaagaagaagtgggaatcattgcagaaaacataacacctgtttatcctcatgggctgagagtattatatgaatcattgccctttcacaaagctgaaaaagttgtaaacatgatatcagggacaaaatctataaccaacttattacagagaacatccgctattaatggtgaagatattgacagggctgtatctatgatgttggagaatctaggattattatctagaatattgtcagtagttgttgatagtatagaaattccaatcaaatctaatggtaggctgatatgttgtcaaatctctaggactttaagagagacatcatggaataatatggaaatagttggagtaacatctcctagcatcactacatgtatggatgtcatatatgcaactagttctcatttgaaggggataattatagaaaagttcagcactgacagaactacaaggggtcaaagaggtccaaaaagcccttgggtagggtcgagtactcaagagaaaaaattagtacctgtttataacagacaaattctttcaaaacaacaaagagaacagctagaagcaattggaaaaatgagatgggtgtataaagggacaccaggcttgcgacgattactcaacaagatctgtcttgggagtttaggcattagttacaaatgtgtaaaacctttattacctaggtttatgagtgtaaatttcttacataggttatctgtcagtagtagacctatggaattcccagcatcagttccagcttatagaacaacaaattaccatttcgacactagtcctattaatcaagcactaagtgagagatttgggaatgaagatattaacttggtcttccaaaatgcgatcagctgtggaattagcataatgagtgtagtagaacaattaacaggtagaagcccaaaacagttagttttaataccccaattagaagaaatagacattatgccaccaccagtgtttcaagggaaattcaattataaattagtagataagataacttctgatcaacatatcttcagtccggacaaaatagatatgttaacactagggaaaatgctcatgcctactataaaaggtcagaaaacagatcagttcttaaataagagagagaattatttccatgggaacaatcttattgagtctttatcagcagcattagcatgtcattggtgtgggatattaacagaacaatgcatagaaaataatattttcaagaaggactggggtgacgggtttatatcagatcatgcttttatggacttcaaaatattcctatgtgtctttaaaactaaacttttatgtagttggggatcccaagggaaaaacattaaagatgaagatatagtagatgaatcaatagataaattgttaaggattgacaatactttttggagaatgttcagcaaagttatgtttgaaccaaaagttaagaaaaggataatgttatatgatgtaaaattcctatcactagtaggctacatagggtttaagaactggtttatagagcagttgagatcagctgaattgcatgaaataccttggattgtcaatgccgaaggtgatttggttgagatcaagtcaattaaaatctatttgcaactgatagaacaaagcttatttttaagaataactgttttgaactatacagatatggcacatgctctcacacgattaatcagaaagaagttaatgtgtgataatgcactgttaaccccaatttcatccccaatggttaacttaactcaagttattgatcccacaacacaattagattacttccccaagataacattcgaaaggctaaaaaattatgacacaagttcaaattatgctaaaggaaagctaacaagaaattacatgatactattgccatggcagcatgttaatagatataactttgtctttagttctactggatgtaaagttagtctgaaaacatgtattggaaaacttatgaaagacttaaatcctaaagttttgtactttattggagaaggagcaggaaattggatggccagaacagcatgtgaatatcctgatattaaatttgtatatagaagtctgaaagatgaccttgatcatcattatcctctggaataccagagagtgataggtgaattaagcagaatcatagatagtggtgaaggactttcaatggaaacaacagacgcaactcaaaaaactcattgggatttgatacacagggtaagcaaagatgctttattaataactttatgtgatgcagaatttaaggacagagatgatttttttaagatggtaattctatggagaaaacatgtattatcatgcagaatttgcactacttatgggacggacctctatttattcgcaaagtatcatgctaaagactgcaatgtaaaattacctttttttgtgagatcagttgctactttcattatgcagggtagtaagctgtcaggttcagaatgctacatactcttaacactaggccaccacaacagtttaccttgccatggagaaatacaaaattctaagatgaaaatagcagtgtgtaatgatttttatgctgcaaaaaaactcgacaataaatcaattgaagctaattgtaaatcacttttgtcagggctaagaatacctataaataagaaggaactagatagacagagaagattattaacactacaaagcaatcattcttctgtggcaacagttggcggtagcaagatcatagagtctaaatggttaacaaacaaagcaagtacaataattgattggttagaacatattttaaattctccaaagggcgaattaaattatgatttttttgaagcattggagaacacttaccctaatatgattaaactaatagataacttagggaatgcagagattaaaaaacttatcaaagtaacaggatacatgcttgtaagtaaaaaatgaaaaatgatgaagatgacaaaatagatgacaacttcatactattctaaattaattatttgattat

SEQ ID NO: 21 - DNA, 13135 bp, human metapneumo virus
acgcgaaaaaaacgcgtataaattaaattccaaacaaaacgggacaaataaaaatgtctcttcaagggattcacctaagtgatctgtcatataaacatgctatattaaaagagtctcaatacacaataaaaagagatgtaggcaccacaactgcagtgacaccttcatcattgcagcaagagataacacttttgtgtggagagattctttacactaaacatactgattacaaatatgctgcagagatagggatacaatatatttgcacagctctaggatcagaaagagtacaacagattttaagaaattcaggtagtgaggttcaggtggttctaaccaagacatactctttagggaaaggtaaaaatagtaaaggggaagagttgcaaatgttagatatacatggagtggaaaagagttgggtagaagaaatagacaaagaggcaagaaaaacaatggtgactttgctaaaggaatcatcaggcaacatcccacaaaaccagaggccttcagcaccagacacaccaataattttattgtgtgtaggtgctttaatattcactaaactagcatcaacaatagaagttggactagagactacagttagaagggctaacagagtgttaagtgatgcgctcaaaagataccctagggtagatataccaaagattgctagatctttttatgaactatttgagcagaaagtgtattacaggagtctattcattgagtatgggaaagctttaggctcatcttcaacaggaagcaaagcagaaagtttgtttgtaaatatatttatgcaagcttatggagccggtcagacaatgctaaggtggggtgtcattgccagatcatctaacaacataatgctagggcatgtatctgtgcaagctgaattgaaacaagttacagaggtttatgatttggtaagagaaatgggtcctgaatctgggcttttacatctaagacaaagtccaaaggcaggactgttatcgttggctaattgccccaattttgctagtgttgttcttggtaatgcttcaggtctaggtataatcggaatgtacaggggaagagtgccaaacacagagctattttctgcagcagaaagttatgccagaagcttaaaagaaagcaacaaaatcaacttctcctcattagggctcacagacgaagaaaaagaagctgcagaacacttcttaaacatgagtgatgacaatcaagatgattatgagtaattaaaaaactgggacaagtcaaaatgtcattccctgaaggaaaagatatcctgttcatgggtaatgaagcagcaaaaatagcagaagctttccagaaatcactaaaaagatcaggtcacaaaagaacccagtctattgtaggggaaaaagtaaacactatatcagaaactctagagctacctaccatcagcaaacctgcacgatcatctacactgctagagccaaaattggcatgggcagacagcagcggagccaccaaaaccacagaaaaacaaacaaccaaaacaacagatcctgttgaagaagaggaactcaatgaaaagaaggtatcaccttccagtgatgggaagactcctgcagagaaaaaatcaaaatctccaaccaatgtaaaaaagaaagtttccttcacatcaaatgaaccagggaaatatactaaactagaaaaagatgccctagatttgctctcagacaatgaggaagaagacgcagagtcctcaatcctaacctttgaagagagagacacatcatcactaagcattgaggctagactagaatcaatagaagagaagctaagcatgatattaggactgcttcgtacacttaacattgcaacagcaggaccaacggctgcaagggatggaatcagagatgcaatgattggtataagagaagaactaatagcagaaataataaaagaagcaaagggaaaagcagccgaaatgatggaagaggaaatgaatcaaaggtcaaaaataggtaatggcagtgtaaaactaaccgagaaggcaaaagaacttaataaaattgttgaagacgagagcacaagtggtgaatcagaagaagaagaagaaccaaaagaaactcaggataacaatcaaggagaagatatctaccagttaatcatgtagtttaataaaaataaacaatgggacaagtcaagatggagtcctatctagtggacacttatcaaggcattccctacacagctgctgttcaagttgatctggtagaaaaagacttactaccagcaagtttgacaatatggtttcctctattccaagccaacacaccaccagcggttttgctcgatcagctaaaaaccttgactataacaactctgtatgctgcatcacagaatggtccaatactcaaagtaaatgcatcagctcagggtgctgctatgtctgtacttcccaaaaaattcgaagtaaatgcaactgtggcacttgatgaatacagcaaacttgactttgacaagttaacggtttgcgatgttaaaacagtttatttgacaaccatgaagccatatgggatggtgtcaaaatttgtgagttcagccaaatcagttggcaaaaagacacatgatctaattgcactgtgtgacttcatggacctagagaaaaatatacctgtgacaataccagcattcataaagtcagtttcaatcaaagagagtgagtcagccactgttgaagctgcaataagcagtgaggccgaccaagcattaacacaagccaaaattgcaccctatgcaggactaatcatgatcatgaccatgaacaatccaaaaggtatattcaagaaactaggagctggaacacaagtgatagtagagctaggggcatatgttcaagccgagagcatcagcaggatctgcaagagctggagtcaccaaggaacaagatatgtactaaaatccagataaaaataactgtcctaatcaataattgcttatataatcctaaagatcaatgagcttattattatagttatataaaaataatttagaactagaaaggtattaatagaaagcgggacaagtaaaaatgtcttggaaagtgatgattatcatttcgttactcataacacctcagcacggactaaaagaaagttatttagaagaatcatgtagtactataactgaaggatatctcagtgttttaagaacaggttggtacaccaatgtctttacattagaagttggtgatgttgaaaatcttacatgtactgatggacctagcttaatcaaaacagaacttgacctaaccaaaagtgctctgagagaactcaaaacagtttctgctgatcagttagcgagagaagaacaaattgaaaatcccagacaatcaaggtttgtcctaggtgcaatagctcttggagttgccacagcagcagcagtcacagcaggcattgcaatagccaaaaccataagacttgagagtgaagtgaatgcaatcaaaggtgctctcaaaacaaccaacgaggcagtatccacactaggaaatggagtgcgagtcctagccactgcagtaagagagctgaaagaatttgtgagcaaaaacctgactagtgcgatcaacaagaacaaatgtgacattgctgatctgaagatggctgtcagcttcagtcaattcaacagaagattcctaaatgttgtgcggcagttttcagacaatgcagggataacaccagcaatatcattggacctaatgactgatgctgagctggccagagctgtatcatacatgccaacatctgcaggacagataaaactaatgttagagaaccgtgcaatggtgaggagaaaaggatttggaatcttgataggggtctacggaagctctgtgatttacatggtccagctgccgatctttggtgtcatagatacaccttgttggataatcaaggcagctccctcttgttcagaaaaagatggaaattatgcttgcctcctaagagaggatcaagggtggtattgcaaaaatgcaggatccactgtttactacccaaatgaaaaagactgcgaaacaagaggtgatcatgttttttgtgacacagcagcagggatcaatgttgctgagcaatcaagagaatgcaacatcaacatatctaccaccaactacccatgcaaagtcagcacaggaagacaccctatcagcatggttgcactatcacctctcggtgctttggtagcttgctacaagggggttagctgctcgattggcagtaatcgggttggaataatcaaacaactacctaaaggctgctcatacataactaaccaggacgcagacactgtaacaattgacaacactgtgtatcaactaagcaaagttgagggtgaacagcatgtaataaaagggagaccagtttcaagcagttttgatccaatcaggtttcctgaggatcagttcaatgttgcgcttgatcaagtctttgaaagcattgaaaacagtcaagcactagtggaccagtcaaacaaaattctgaacagtgcagaaaaaggaaacactggtttcattattgtaataattttgattgctgttcttgggttaaccatgatttcagtgagcatcatcatcataatcaaaaaaacaaggaagcccacaggggcacctccagagctgaatggtgttaccaacggcggttttataccgcatagttagttaattaaaaaatgggacaaatcatcatgtctcgcaaagctccatgcaaatatgaagtacggggcaagtgcaacaggggaagtgagtgcaaattcaaccacaattactggagctggcctgataggtatttattgttaagatcaaattatctcttgaatcagcttttaagaaacactgataaggctgatggtttgtcaataatatcaggagcaggtagagaagataggactcaagactttgttcttggttctactaatgtggttcaagggtacattgataacaatcaaggaataacaaaggctgcagcttgctatagtctacataacataataaaacagctacaagaaatagaagtaagacaggctagagataataagctttctgacagcaaacatgtggcacttcacaacttgatattatcctatatggagatgagcaaaactcctgcatccctgattaataacctaaagaaactaccaagagaaaaactgaagaaattagcgaaattaataattgatttatcagcaggaactgataatgactcttcatatgccttgcaagacagtgaaagcactaatcaagtgcagtaagcatggtcccaaattcattaccatagaggcagatgatatgatatggacacacaaagaattaaaggagacactgtctgatgggatagtaaaatcacacaccaatatttacagttgttatttagaaaatatagaaataatatatgttaaagcttacttaagttagtaaaaaataaatagaatgggataaatgacaatgaaaacattagatgtcataaaaagtgatggatcctcagaaacatgtaatcaactcaaaaaaataataaaaaaacactcaggtaaattgcttattgcattaaaactgatattggccttattgacgtttttcacagtaacaattactgttaactatataaaagtagaaaacaatttgcaggcatgtcaattaaaaaatgaatcagacaaaaaggacacaaagctaaataccacatcaacaacaatcagacccattcctgatctaaatgcagtacagtacttgaaaaggctgattcagaaacacaccaactttgtcataaaagacagagatacctgttggagaatacacacgaatcaatgcacaaatataaaaatatataagttcttatgtttcgggtttatgaattcaacaaatacagactgtgaagaactaacagttttatgtgataaaaagtcaaaaaccatgacagaaaaacataggaaagcagagtgtcactgtctacatacaaccgagtggtggtgttattatctttaagagaaaactcggctttcaacattaaaatcagaacaaatcctatccagatctattaatataatagtttagtcattcaaaaactctaaatattgtctagacttcacaacactttgcggtcatatgcaataatcaatggtcaaaccactgttgcaaactcacccataatataatcactgagtaatacaaaacaagaaaatgggacaagtggccatggaagtaagagtggagaacattcgggcaatagacatgttcaaagcaaaaatgaaaaaccgtataagaagtagcaagtgctatagaaatgctacactgatccttattggattaacagcattaagtatggcacttaatatttttttaatcattgattatgcaatgttaaaaaacatgaccaaagtggaacactgtgttaatatgccgccggtagaaccaagcaagaagaccccaatgacctctgcagtagacttaaacaccaaacccaatccacagcaggcaacacagttggccgcagaggattcaacatctctagcagcaacctcagaggaccatctacacacagggacaactccaacaccagatgcaacagtctctcagcaaaccacagacgagtacacaacattgctgagatcaaccaacagacagaccacccaaacaaccacagagaaaaagccaaccggagcaacaaccaaaaaagaaaccacaactcgaactacaagcacagctgcaacccaaacactcaacactaccaaccaaactagctatgtgagagaggcaaccacaacatccgccagatccagaaacagtgccacaactcaaagcagcgaccaaacaacccaggcagcagacccaagctcccaaccacaccatacacagaaaagcacaacaacaacatacaacacagacacatcctctccaagtagttaacaaaaaaactataaaataatcatgaaaaccgaaaaactagaaaagttaatttgaactcagaaaagaacacaaacactatatgaattgtttgagcgtatatactaatgaaatagcatctgtttgtgcatcaataataccatcattatttaagaaataagaagaagctaaaattcaagggacaaataacaatggatccattttgtgaatccactgtcaatgtttatcttcctgactcatatctcaaaggagtaatatctttcagtgaaaccaatgcaattggctcatgccttttgaaaagaccctatctaaaaaaagataacactgctaaagttgctgtagaaaaccctgttgttgaacatgtcaggcttagaaatgcagtcatgaccaaaatgaagatatcagattataaagtggttgaaccaattaatatgcagcatgaaataatgaaaaatatacacagttgtgagctcacattattaaaacaattcttaacaagaagtaaaaacattagctctctaaaattaagtatgatatgtgattggttacagttaaaatccacctcagataacacatcaattcttaattttatagatgtggagtttatacctgtttgggtgagcaattggtttagtaactggtataatctcaataaattaatcttagagtttagaagagaggaagtaataagaactggttcaattttatgtagatcactaggcaagttagttttcattgtatcatcttatgggtgtgtagtaaaaagcaacaaaagtaaaagagtaagttttttcacatataaccaactgttaacatggaaagatgtgatgttaagtaggttcaatgcaaacttttgtatatgggtaagtaacaacctgaacaaaaatcaagaaggactaggatttagaagtaatctgcaaggtatgttaaccaataaattatatgaaactgttgattatatgttaagtctatgtagtaatgaagggttctcactagtgaaagagttcgaaggctttattatgagtgaaattcttaaaattactgagcatgctcaattcagtactaggtttaggaatactttattaaatgggttgactgaacaattatcaatgttgaaagctaaaaacagatctagagttcttggcactatattagaaaacaatgattaccccatgtatgaagtagtacttaaattattaggggacactttgaaaagtataaaattattaattaacaagaatttagaaaatgctgcagaattatattatatattcagaatttttggacaccctatggtagatgagagggaagcaatggatgctgttaaattaaataatgagattacaaaaattcttaaactggagagcttaacagaactaagaggagcatttatactaagaattataaaagggtttgtagataataataaaagatggcctaaaattaagaatttaaaagtgctcagtaaaagatgggttatgtatttcaaagccaaaagttaccctagccaacttgagctaagtgtacaagattttttagaacttgctgcagtacaattcgaacaggaattttctgtccctgaaaaaaccaaccttgagatggtattaaatgataaagcaatatctcctccaaaaaagttaatatggtcggtatatccaaaaaattatctacctgaaattataaaaaatcaatatttagaagaggtcttcaatgcaagtgacagtcaaagaacgaggagagtcttagaattttacttaaaagattgcaaatttgatcaaaaagaccttaaacgttatgtacttaaacaagagtatctaaatgacaaagaccacattgtctcattaactgggaaggaaagagaattaagtgtaggcaggatgtttgcaatgcaaccaggcaaacaaagacaaatacagatactagctgagaaacttctagctgataatattgtaccctttttcccagaaactttaacaaagtatggtgacttggatctccaaagaattatggaaatgaaatcagaactttcttccattaaaactaggaagaatgatagttacaacaattatattgcaagagcctccatagtaacagacctaagtaaattcaatcaagcctttagatatgaaaccacagctatctgtgcagatgtagcagatgagttacatggtacgcaaagcttattttgttggttacatcttattgttcccatgaccacaatgatatgtgcatacagacatgcaccaccagaaacaaagggggagtatgacatagacaaaatagaagagcaaagtgggctatacagatatcatatgggagggattgaagggtggtgtcagaagttatggacaatggaagcgatatccttgttagatgtagtatctgttaagactcgttgtcagatgacctctctattaaacggagacaatcaatcaatagatgtcagtaaaccagtaaaattgtctgaaggtatagatgaagtaaaagcagattatagcttagcaattaaaatgcttaaagagataagagatgcctataaaaacattggccataaactcaaagaaggtgaaacatatatatcaagagatctccaatttataagtaaggtgattcaatctgagggggtcatgcatcctacccccataaaaaagatattaagggtaggtccctggataaatacaatactagatgacattaaaaccagtgcagaatcaatagggagtctgtgtcaagaactagagttcagaggagaaagtatgctagttagcttgatattaaggaatttctggctgtataacttatacatgcatgagtcaaaacagcatccgttagctggaaaacaactgtttaagcaattgaacaaaacactaacatctgtgcaaagattttttgagctgaagaaagaaaatgatgtggttgacctatggatgaatataccaatgcagtttggagggggagacccagtagttttttacagatctttttacagaaggactcctgatttcctgactgaagcaatcagccatgtggatttactgttaaaagtttcgaacaatattaaaaatgagactaagatacgattctttaaagccttattatctatagaaaagaatgaacgtgcaacattaacaacactaatgagagacccccaggcggtaggatcggaaagacaagctaaggtaacaagtgatataaatagaacagcagttactagcatactgagtctatctccgaatcagctcttttgtgatagtgctatacactatagcagaaatgaagaagaagtcgggatcattgcagacaacataacacctgtttatcctcacggattgagagtgctctatgaatcactaccttttcataaggctgaaaaggttgtcaatatgatatcaggtacaaagtctataactaacctattgcagagaacatctgctatcaatggtgaagatattgatagagcagtgtctatgatgttagagaacttagggttgttatctaggatattgtcagtaataattaatagtatagaaataccaattaagtccaatggcagattgatatgctgtcaaatttctaagactttgagagaaaaatcatggaacaatatggaaatagtaggagtgacatctccaagtattgtaacatgtatggatgttgtgtatgcaactagttctcatttaaaaggaataattattgaaaaattcagtactgacaagaccacaagaggtcagaggggaccaaaaagcccctgggtaggatcaagcactcaagagaaaaaattagttcctgtttataatagacaaattctttcaaaacaacaaaaggagcaactggaagcaataggaaaaatgaggtgggtgtataaaggaactccagggctaagaagattgctcaataagatttgcataggaagtttaggtattagctataaatgtgtaaaacctctattaccaagattcatgagtgtaaacttcttacataggttatctgttagtagcagacccatggaattcccagcttctgttccagcttataggacaacaaattaccactttgacactagtccaatcaaccaagcattaagtgagaggttcgggaacgaagacattaatctagtgttccaaaatgcaatcagctgcggaattagtataatgagtgttgtagaacagttaactggtagaagcccaaaacaattagtcttaatcccccaattagaagagatagatattatgcctcctcctgtatttcaaggaaaattcaattataaactagttgataaaataacctctgatcaacacatcttcagtcctgacaaaatagacatattaacactagggaagatgcttatgcctactataaaaggtcaaaaaactgatcagttcttaaataagagagaaaactatttccatggaaataatttaattgaatctttatctgcagcacttgcatgccactggtgtggaatattaacagaacagtgtgtagaaaacaatatctttaggaaagactggggtgatgggttcatatcagatcatgccttcatggatttcaagatatttctatgtgtatttaaaaccaaacttttatgtagttggggatcccaagggaaaaatgtaaaagatgaagatataatagatgaatccattgacaaattattaagaattgacaacactttttggagaatgttcagcaaagtcatgtttgaatcaaaggtcaaaaaaagaataatgttatatgatgtaaaattcctatcattagtaggttatataggatttaaaaactggtttatagagcagttaagagtagtagaattgcatgaagtgccctggattgtcaatgctgaaggggagctagttgaaattaaaccaatcaaaatttatttgcagttaatagaacaaagtctatctttaagaataactgttttgaattatacagacatggcacatgctcttacacgattaattaggaagaaattgatgtgtgataatgcactcttcaatccaagttcatcaccaatgtttagtctaactcaagttatcgatcctacaacacagctagactattttcctaaggtgatatttgaaaggttaaaaagttatgataccagttcagactacaacaaagggaagttaacaagaaattacatgacattattaccatggcagcacgtaaacaggtataattttgtctttagttcaacaggatgtaaaatcagcttgaagacatgcatcgggaaattgataaaggacttaaaccctaaggttctttactttattggagaaggagcaggtaactggatggcaagaacagcatgtgagtatcctgacataaaatttgtatataggagtttaaaggatgatcttgatcatcattacccattagaatatcaaagggtaataggtgatttaaatagggtaatagatggtggtgaaggactatcaatggagaccacagatgcaactcaaaagactcattgggacttaatacacagaataagtaaagatgctttattgataacattgtgtgatgcagaattcaaaaacagagatgatttctttaaaatggtaattctttggagaaaacatgtattatcatgtagaatctgtacagcttatggaacagatctttacttatttgcaaagtatcatgcgacggactgcaatataaaattaccattttttgtaaggtctgtagctacttttattatgcaaggaagcaaattgtcaggatcagaatgttacatacttttaacattaggtcatcacaataatctgccatgccatggagaaatacaaaattccaaaatgagaatagcagtgtgtaatgatttccatgcctcaaaaaaactagacaacaaatcaattgaagctaactgtaaatctcttctatcaggattaagaataccaataaacaaaaaagagttaaatagacaaaagaaactgttaacactacaaagcaatcattcttccatagcaacagttggcggcagtaagattatagaatccaaatggttaaagaataaagcaagtacaataattgattggttagagcatatcttgaattctccaaaaggtgaattaaactatgatttctttgaagcattagagaacacataccccaatatgatcaagcttatagataacctgggaaatgcagagataaaaaaactaatcaaagttcctgggtatatgcttgtgagtaagaagtaataataat

SEQ ID NO: 22 - DNA, 24 bp, Artificial Sequence
  Primer
aaagaattcacgagaaaaaaacgc

SEQ ID NO: 23 - DNA, 22 bp, Artificial Sequence
  Primer
ctgtggtctctagtcccacttc

SEQ ID NO: 24 - DNA, 18 bp, Artificial Sequence
  Primer
catgcaagcttatggggc

SEQ ID NO: 25 - DNA, 21 bp, Artificial Sequence
  Primer
cagagtggttattgtcagggt

SEQ ID NO: 26 - DNA, 19 bp, Artificial Sequence
  Primer
gtagaactaggagcatatg

SEQ ID NO: 27 - DNA, 22 bp, Artificial Sequence
  Primer
tccccaatgtagatactgcttc

SEQ ID NO: 28 - DNA, 20 bp, Artificial Sequence
  Primer
gcactcaagagataccctag

SEQ ID NO: 29 - DNA, 22 bp, Artificial Sequence
  Primer
agactttctgctttgctgcctg

SEQ ID NO: 30 - DNA, 20 bp, Artificial Sequence
  Primer
ccctgacaataaccactctg

SEQ ID NO: 31 - DNA, 22 bp, Artificial Sequence
  Primer
gccaactgatttggctgagctc

SEQ ID NO: 32 - DNA, 23 bp, Artificial Sequence
  Primer
tgcctatctcctcttggggcttg

SEQ ID NO: 33 - DNA, 22 bp, Artificial Sequence
  Primer
tcaaagctgcttgacactggcc

SEQ ID NO: 34 - DNA, 22 bp, Artificial Sequence
  Primer
catgcccactataaaaggtcag

SEQ ID NO: 35 - DNA, 20 bp, Artificial Sequence
  Primer
caccccagtctttcttgaaa

SEQ ID NO: 36 - DNA, 18 bp, Artificial Sequence
  Primer
tgcttgtacttcccaaag

SEQ ID NO: 37 - DNA, 18 bp, Artificial Sequence
  Primer
tatttgaacaaaaagtgt

SEQ ID NO: 38 - DNA, 19 bp, Artificial Sequence
  Primer
tggtgtgggatattaacag

SEQ ID NO: 39 - DNA, 66 bp, Artificial Sequence
  Primer
aagcccaaaagctggactgtttagccaactgtcccaactttgcaaggttctcggaaatgcctcagg

SEQ ID NO: 40 - DNA, 66 bp, Artificial Sequence
  Primer
aagcccaaaagctggactgtttagccaactgtcctaactttgcaaggttctcggaaatgcctcagg

SEQ ID NO: 41 - DNA, 66 bp, Artificial Sequence
  Primer
aagcccaaaagctggactgtttagccaattgtcccaactttgcaaggttctcggcaatgcctcagg

SEQ ID NO: 42 - DNA, 66 bp, Artificial Sequence
  Primer
aagcccaaaagctggattgtttagccaattgtcccaactttgcaaggttctcggcaatgcctcagg

SEQ ID NO: 43 - DNA, 66 bp, Artificial Sequence
  Primer
aagcccaaaagctggactgtttagccaattgtcccaactttgctaggttctcggcaatgcctcagg

SEQ ID NO: 44 - DNA, 66 bp, Artificial Sequence
  Primer
aagtccaaaggcagggctgtttggccaattgccccaattttgctaggttcttggcaatgcttcagg

SEQ ID NO: 45 - DNA, 66 bp, Artificial Sequence; identical to SEQ ID NO: 44
  Primer

SEQ ID NO: 46 - DNA, 18 bp, Artificial Sequence
  Primer
cccaccaccagagagaaa

SEQ ID NO: 47 - DNA, 18 bp, Artificial Sequence
  Primer
accaccagagagaaaccc

SEQ ID NO: 48 - DNA, 18 bp, Artificial Sequence
  Primer
accagagagaaacccacc

SEQ ID NO: 49 - DNA, 18 bp, Artificial Sequence
  Primer
agagagaaacccaccacc

SEQ ID NO: 50 - DNA, 18 bp, Artificial Sequence
  Primer
gagaaacccaccaccaga

SEQ ID NO: 51 - DNA, 18 bp, Artificial Sequence
  Primer
aaacccaccaccagagag

SEQ ID NO: 52 - DNA, 18 bp, Artificial Sequence
  Primer
ggaggcaagcgaacgcaa

SEQ ID NO: 53 - DNA, 18 bp, Artificial Sequence
  Primer
ggcaagcgaacgcaagga

SEQ ID NO: 54 - DNA, 18 bp, Artificial Sequence
  Primer
aagcgaacgcaaggaggc

SEQ ID NO: 55 - DNA, 18 bp, Artificial Sequence
  Primer
cgaacgcaaggaggcaag

SEQ ID NO: 56 - DNA, 18 bp, Artificial Sequence
  Primer
acgcaaggaggcaagcga

SEQ ID NO: 57 - DNA, 18 bp, Artificial Sequence
  Primer
caaggaggcaagcgaacg

SEQ ID NO: 58 - DNA, 20 bp, Artificial Sequence
  Primer
tgttgtcgagactattccaa

SEQ ID NO: 59 - DNA, 20 bp, Artificial Sequence
  Primer
tgttgwaccagttgcagtct

SEQ ID NO: 60 - DNA, 23 bp, Artificial Sequence
  Primer
tgctgcttctattgagaaacgcc

SEQ ID NO: 61 - DNA, 20 bp, Artificial Sequence
  Primer
ggtgacttcyaatagggcca

SEQ ID NO: 62 - DNA, 21 bp, Artificial Sequence
  Primer
ctcgaggttgtcaggatatag

SEQ ID NO: 63 - DNA, 21 bp, Artificial Sequence
  Primer
ctttgggagttgaacacagtt

SEQ ID NO: 64 - DNA, 20 bp, Artificial Sequence
  Primer
ttcrgttttagctgcttacg

SEQ ID NO: 65 - DNA, 21 bp, Artificial Sequence
  Primer
aggcaaatctctggataatgc

SEQ ID NO: 66 - DNA, 18 bp, Artificial Sequence
  Primer
tcgtaacgtctcgtgacc

SEQ ID NO: 67 - DNA, 20 bp, Artificial Sequence
  Primer
ggagatctttctagagtgag

SEQ ID NO: 68 - DNA, 21 bp, Artificial Sequence
  Primer
  misc_feature 10, 19: n = A,T,C or G
  misc_feature 10, 19: n = A,T,C or G
ccttggtgantctatccgnag

SEQ ID NO: 69 - DNA, 25 bp, Artificial Sequence
  Primer
  misc_feature 17: n = A,T,C or G
  misc_feature 17: n = A,T,C or G
ctgccactgctagttgngataatcc

SEQ ID NO: 70 - DNA, 25 bp, Artificial Sequence
  Primer
gggcttctaagcgacccagatcttg

SEQ ID NO: 71 - DNA, 27 bp, Artificial Sequence
  Primer
gaatttccttatggacaagctctgtgc

SEQ ID NO: 72 - DNA, 25 bp, Artificial Sequence
  Primer
ggagcaggaactccaagacctggag

SEQ ID NO: 73 - DNA, 25 bp, Artificial Sequence
  Primer
gctcaacctcatcacatactaaccc

SEQ ID NO: 74 - DNA, 27 bp, Artificial Sequence
  Primer
gagatgggcgggcaagtgcggcaacag

SEQ ID NO: 75 - DNA, 28 bp, Artificial Sequence
  Primer
gcctttgcaatcaggatccaaatttggg

SEQ ID NO: 76 - DNA, 24 bp, Artificial Sequence
  Primer
ctgctgcagttcaggaaacatcag

SEQ ID NO: 77 - DNA, 22 bp, Artificial Sequence
  Primer
accggatgtgctcacagaactg

SEQ ID NO: 78 - DNA, 21 bp, Artificial Sequence
  Primer
tttgttataggcatatcattg

SEQ ID NO: 79 - DNA, 18 bp, Artificial Sequence
  Primer
ttaaccagcaaagtgtta

SEQ ID NO: 80 - DNA, 21 bp, Artificial Sequence
  Primer
ttagggcaagagatggtaagg

SEQ ID NO: 81 - DNA, 19 bp, Artificial Sequence
  Primer
ttataacaatgatggaggg

SEQ ID NO: 82 - DNA, 21 bp, Artificial Sequence
  Primer
cattaaaaagggcacagacgc

SEQ ID NO: 83 - DNA, 17 bp, Artificial Sequence
  Primer
tggacattctccgcagt

SEQ ID NO: 84 - DNA, 907 bp, human metapneumo virus
atggaggtgaaagtggagaacattcgaacaatagatatgctcaaagcaagagtaaaaaatcgtgtggcacgcagcaaatgctttaaaaatgcctctttggtcctcataggaataactacattgagtattgccctcaatatctatctgatcataaactataaaatgcaaaaaaacacatctgaatcagaacatcacaccagctcatcacccatggaatccagcagagaaactccaacggtccccacagacaactcagacaccaactcaagcccacagcatccaactcaacagtccacagaaggctccacactctactttgcagcctcagcaagctcaccagagacagaaccaacatcaacaccagatacaacaaaccgcccgcccttcgtcgacacacacacaacaccaccaagcgcaagcagaacaaagacaagtccggcagtccacacaaaaaacaacccaaggacaagctctagaacacattctccaccacgggcaacgacaaggacggcacgcagaaccaccactctccgcacaagcagcacaagaaagagaccgtccacagcatcagtccaacctgacatcagcgcaacaacccacaaaaacgaagaagcaagtccagcgagcccacaaacatctgcaagcacaacaagaatacaaaggaaaagcgtggaggccaacacatcaacaacatacaaccaaactagttaacaaaaaatacaaaataactctaagataaaccatgcagacaccaacaatggagaagccaaaagacaattcacaatctccccaaaaaggcaacaacaccatattagctctgcccaaatctccctggaaaaaacactcgcccatataccaaaaataccacaaccaccccaagaaaaaaactgggcaaaacaacacccaa

SEQ ID NO: 85 - DNA, 908 bp, human metapneumo virus
atggaggtgaaagtggagaacattcgaacaatagatatgctcaaagcaagtgtaaaaaatcgtgtggcacgcagcaaatgctttaaaaatgcctctttggtcctcataggaataactacattgagtattgccctcaatatctatctgatcataaactataaaatgcaaaaaaacacatctgaatcagaacatcacaccagctcatcacccatggaatccagcagagaaactccaacggtccccacagacaactcagacaccaactcaagcccacagcatccaactcaacagtccacagaaggctccacactctactttgcagcctcagcaagctcaccagagacagaaccaacatcaacaccagatacaacaaaccgcccgcccttcgtcgacacacacacaacaccaccaagcgcaagcagaacaaagacaagtccggcagtccacacaaaaaacaacccaaggacaagctctagaacacattctccaccacgggcaacgacaaggacggcacgcaggaaccaccactctccgcacaagcagcacaagaaagagaccgtccacagcatcagtccaacctgacatcagcgcaacaacccacaaaaacgaagaagcaagtccagcgagcccacaaacatctgcaagcacaacaagaatacaaaggaaaagcgtggaggccaacacatcaacaacatacaaccaaactagttaacaaaaaatacaaaataactctaagataaaccatgcagacaccaacaatggagaagccaaaagacaattcacaatctccccaaaaaggcaacaacaccatattagctctgcccaaatctccctggaaaaaacactcgcccatataccaaaaataccacaaccaccccaagaaaaaaactgggcaaaacaacacccaa

SEQ ID NO: 86 - DNA, 907 bp, human metapneumo virus
atggaggtgaaagtggagaacattcgaacaatagatatgctcaaagcaagagtaaaaaatcgtgtggcacgcagcaaatgctttaaaaatgcctctttggtcctcataggaataactacactgagtattgccctcaatatctatctgatcataaactataaaatgcaaaaaaacacatctgaatcagaacatcacaccagctcatcacccatggaatccagcagagaaactccaacggtccccacagataattcagacaccaactcaagcccacaacatccaactcaacagtccacagaaggctccacactctactttgcagcctcagcaaactcaccagagacagaaccaacatcaacaccagacacaacaaaccgcccgcccttcgtcgacacacacacaacaccaccaagcgcaagcagaacaaagacaagtccggcagtccacacaaaaaacaacccaaggataagctccagaacacactctccaccatgggcaacgacaaggacggcacgcagaaccaccactctccgcacaagcagcacaagaaagagaccgtccacagcatcagcccaacccgacatcagcgcaacaacccacaaaaacgaagaagcaagtccagcgagcccacaaacatctgcaagcacaacaagaacacaaaggaaaagcgtggaggccaacacatcaacaacatacaaccaaactagttaacaaaaaatacaaaataactctaagataaaccatgcagacaccaacaatggagaagtcaaaagacaattcacaatctccccaaaaaggcaacaacaccatattagctctgcccaaatctccctggaaaaaacactcgcccatataccaaaaataccacaaccaccccaagaaaaaaactgggcaaaacaacacccaa

SEQ ID NO: 87 - DNA, 907 bp, human metapneumo virus
atggaggtgaaagtggagaacattcgaacaatagatatgctcaaagcaagagtaaaaaatcgtgtggcacgcagcaaatgctttaaaaatgcctctttggtcctcataggaataactacattgagtattgccctcaatatctatctgatcataaactataaaatgcaaaaaaacacatctgaatcagaacatcacaccagctcatcacccatggaatccagcagagaaactccaacggtccccacagataattcagacaccaactcaagcccacaacatccaactcaacagtccacagaaggctccacactctactttgcagcctcagcaaactcaccagagacagaaccaacatcaacaccagacacaacagaccgcccgcccttcgtcgacacacacacaacaccaccaagcgcaagcagaacaaagacaagtccggcagtccacacaaaaaacaacccaaggataagctccagaacacattctccaccatgggcaacgacaaggacggcacgcagaaccaccactctccgcacaagcagcacaagaaagagaccgtccacagcatcagtccaacccgacatcagcgcaacaacccacaaaaacgaagaagcaagtccagcgagcccacaaacatctgcaagcacaacaagaacacaaaggaaaagcgtggaggccaacacatcaacaacatacaaccaaactagttaacaaaaaatacaaaataactctaagataaaccatgcagacaccaacaatggagaagtcaaaagacaattcacaatctccccaaaaaggcaacaacaccatattagctctgcccaaatctccctggaaaaaacactcgcccatataccaaaaataccacaaccaccccaagaaaaaaactgggcaaaacaacacccaa

SEQ ID NO: 88 - DNA, 907 bp, human metapneumo virus
atggaggtgaaagtggagaacattcgaacaatagatatgctcaaagcaagagtaaaaaatcgtgtggcacgcagcaaatgctttaaaaatgcctctttggtcctcataggaataactacattgagtattgccctcaatatctatctgatcataaactataaaatgcaaaaaaacacatctgaatcagaacatcacaccagctcatcacccatggaatccagcagagaaactccaacggtccccacagataattcagacaccaactcaagcccacaacatccaactcaacagtccacagaaggctccacactctactttgcagcctcagcaagctcaccagagacagaaccaacatcaacaccagacacaacagaccgcccgcccttcgtcgacacacacacaacaccaccaagcgcaagcagaacaaagacaagtccggcagtccacacaaaaaacaacccaaggataagctccagaacacattctccaccatgggcaacgacaaggacggcacgcagaaccaccactctccgcacaagcagcacaagaaagagaccgtccacagcatcagtccaacccgacatcagcgcaacaacccacaaaaacgaagaagcaagtccagcgagcccacaaacatctgcaagcacaacaagaacacaaaggaaaagcgtggaggccaacacatcaacaacatacaaccaaactagttaacaaaaaatacaaaataactctaagataaaccatgcagacaccaacaatggagaagtcaaaagacaattcacaatctccccaaaaaggcaacaacaccatattagctctgcccaaatctccctggaaaaaacactcgcccatataccaaaaataccacaaccaccccaagaaaaaaactgggcaaaacaacacccaa

SEQ ID NO: 89 - DNA, 907 bp, human metapneumo virus
atggaggtgaaagtggagaacattcgaacaatagatatgctcaaagcaagagtgaaaaatcgtgtggcacgcagcaaatgctttaaaaatgcctctttgatcctaataggaataactacattgagtatagccctcaatatctatctgatcataaactatacaatgcaagaaaacacatccgaatcagaacatcacaccagctcatcacccatggaatccagcagggaaactccaacggtccccatagacaactcagacaccaatccaggctcacagtatccaactcaacagtccacagaagactccacactccactctgcagcttcagcaagctcaccagagacagaaccaacatcaacaccagacacaacaagccgcccgcccttcgtcgacacacacacaacaccaccaagtgcaagcaggacaaggacaagtccggcagtccacacaaaaaacaatccaagggtaagccccagaacacattccccaccatgggcaatgacaaggacggtccgcggaaccaccactctccgcacaagcagcacaagaaaaagactgtctacagcatcagtccaacccgacagcagcgcaacaacccacaaacacgaagaaacaagcccagtgagcccacaaacatctgcaagcacagcaagaccacaaaggaagggcatggaggccagcacatcaacaacatacaaccaaactagttaacaaaaaatacaaaataactctaagataaaccatgtagacaccaacaattgagaagccaaaaggcaattcacaatctcccaaaaaagcaacaacaccatattagctccgcttaaatctccctgaaaaaaacactcacccatataccaactataccacaaccatcccaagaaaaaaggctgggcaaaacaacacccaa

SEQ ID NO: 90 - DNA, 908 bp, human metapneumo virus
atggaggtgaaagtggagaacattcgaacaatagatatgctcaaagcaagagtgaaaaatcgtgtggcacgcagcaaatgctttaaaaatgcctctttgatcctaataggaataactacattgagtatagccctcaatatctatctgatcataaactatacaatgcaagaaaacacatccgaatcagaacatcacaccagttcatcacccatggaatccagcagggaaactccaacggtccctatggacaactcagacaccaatccaggctcacagtatccaactcaacagtccacagaaggctccacactccactttgcagcctcagcaagctcaccagagacagaaccaacatcaacaccagacacaacaagccgcccgcccttcgtcgacacacacacaacaccatcaagtgcaagcagaacaaagacaagtccggcagtccacacaaaaaacaatctaaggataagccccagaacacattccccaccatgggcaatgacaaggacggtccgtggaaccaccactctccgcacaagcagcataagaaaaagaccgtccacagcatcagtccaacctgacagcagcgcaacaacccacaaacacgaagaagcaagcccagtgagcccgcaagcatctgcaagcacagcaagaccacaaaggaagggcatggaggccagcacatcaacaacatacaaccaaactagttaacaaaaaatataaaataactctaagataaaccatgtagacaccaacaattgagaagccaaaaggcaattcacaatctccccaaaaaggcaacaacaccatattagctccgcttaaatctccctggaaaaaacactcgcccatataccaactataccacaaccatcccaaggaaaaaagctgggtaaaacaacacccaa

SEQ ID NO: 91 - DNA, 908 bp, human metapneumo virus
atggaggtgaaagtggagaacattcgaacaatagatatgctcaaagcaagagtgaaaaatcgtgtggcacgcagcaaatgctttaaaaatgcctctttgatcctaataggaataactacattgagtatagccctcaatatctatctgatcataaactatacaatgcaagaaaacacatccgaatcagaacatcacaccagctcatcacccatggaatccagcagagaaactccaacggtccctatggacaactcagacaccaatccaggctcacagtatccaactcaacagtccacagaaggctccacactccactttgcagcctcagcaagctcaccagagacagaaccaacatcaacaccagacacaacaagccgcccgcccttcgtcgacacacacacaacaccatcaagtgcaagcagaataaggacaagtccggcagtccacacaaaaaacaatctaaggataagccccagaacacattccccaccatgggcaatgacaaggacggtccgtggaaccaccactctccgcacaagcagcataagaaaaagaccgtccacagcatcagtccaacctgacagcagcgcaacaacccacaaacacgaagaagcaagcccagtgagcccgcaagcatctgcaagcacagcaagaccacaaaggaagggcatggaggccagcacatcaacaacatacaaccaaactagttaacaaaaaatatacaataactctaagataaaccatgtagacaccaacaattgagaagccaaaaggcaattcacaatctccccaaaaaggcaacaacaccatattagctccgcttaagtctccctggaaaaaacactcgcccatataccaactataccacaaccatccaaagaaaaaaagctgggcaaaacaacacccaa

SEQ ID NO: 92 - DNA, 888 bp, human metapneumo virus
atggaggtgaaagtagagaacattcgagcaatagacatgctcaaagcaagagtgaaaaatcgtgtggcacgtagcaaatgctttaaaaatgcttctttaatcctcataggaataactacactgagtatagctctcaatatctatctgatcataaactacacaatacaaaaaaccacatccgaatcagaacaccacaccagctcaccacccacagaacccaacaaggaagcttcaacaatctccacagacaacccagacatcaatccaagctcacagcatccaactcaacagtccacagaaaaccccacactcaaccccgcagcatcagcgagcccatcagaaacagaaccagcatcaacaccagacacaacaaaccgcctgtcctccgtagacaggtccacagcacaaccaagtgaaagcagaacaaagacaaaaccgacagtccacacaatcaacaacccaaacacagcttccagtacacaatccccaccacggacaacaacgaaggcaatccgcagagccaccactttccgcatgagcagcacaggaaaaagaccaaccacaacattagtccagtccgacagcagcaccacaacccaaaatcatgaagaaacaggttcagcgaacccacaggcgtctgcaagcacaatgcaaaactagcacaccaataatataaaaccaaattagttaacaaaaaatgcgagatagctctaaagcaaaacatgtaggtaccaacaatcaagaaaccaaaagacaactcacaatctccctaaaacagcaacgacaccatgtcagctttgctcaaatctctctgggagaaacttctacccacatactaacaacatcacaaccatctcaagaaaagaaactgggcaaaacagcatccaa

SEQ ID NO: 93 - DNA, 888 bp, human metapneumo virus
atggaggtgaaagtagagaacattcgagcaatagacatgctcaaagcaagagtgaaaaatcgtgtggcacgcagcaaatgctttaaaaatgcttctttaatcctcataggaataactacactgagtatagccctcaatatctatctgatcataaactacacaatacaaaaaaccacatctgaatcagaacaccacactagctcaccacccacagaatccaacaaagaaacttcaacaatccccatagacaacccagacatcaatccaaactcacagcatccaacccaacagtccacagaaagccccacactcaaccccgcagcctcggtgagcccatcagaaacagaaccagcatcaacaccagacacaacaaaccgcctgtcctccgtagacagatccacaacacaaccaagtgaaagcagaacaaagacaaaaccaacagtccacacaaaaaacaatccaagtacagtttccagaacacaatccccactacgggcaacaacgaaggcggtcctcagagccaccgctttccgcacgagcagcacaagaaaaagaccaaccacaacatcagtccagtctgacagcagcaccacaacccaaaatcatgaagaaacaagttcagcgaacccacaggcatctgcaagcacaatgcaaagccagcacaccaacaacataaaaccaaattagttaacaaaaaatacgagatagctctaaagtaaaacatgtaggtaccaacaatcaaggaatcaaaagacaactcacaatctccctaaaacagcaacaacatcatgtcagttttgctcaaatctccctgggagaaactttcgcccacatactaacaacatcacaaccatctcaagaaaagaaactgggcaaaacagcacccaa

SEQ ID NO: 94 - DNA, 888 bp, human metapneumo virus
atggaggtgaaagtagagaacatccgagcagtagacatgctcaaagcaagagtcaaaaatcgtgtggcacgcagcaaatgctttaaaaatgcctccttaatcctcgtaggaataactacactgagcatagccctcaatatctatctgatcgtaaactacacaatacaaaaaaccacatccgaatcagaacaccacaccagctcatcacccacagaatccaacaaaggaacttcaacaatccccacagacaacccagacatcaatccaaattcacaacatccaactcaacagtccacagaaagccccacactcaacaccgcagcctcggtgagcccatcagaaacagaaccagcatcaacaccagacacaacaaaccgcctgtcctccgcagacagatccacaacacaaccaagtgaaagcagaacaaagacaaagctgacagtccacacaaaaaacaacctaagtacagcctccagaacacaatcaccaccacgggcaacaacgaaggcggtcctcagagacaccgccttccacacgagcagcacaggaaaaagaccaaccacaacatcagtccagtctggcagcagcaccacaactcaaaatcatgaagaaacaagttcatcgaacccacaggcatctgcaagcacaatgcaagaccaggacaccaacaatacaaaacaaaattagttaacaaaaaatacaagatagctctaaagtaaaacatgtaggtaccaacagtaaagaaatcaaaagacaactcacaatctccccaaaacagcaacaacatcatgtcagcttcgctcaaatctccctgggagaaactctcgcccacatactaacaacatcacaactatctcaagaaaagaaactgggcaaaaaaacactcaa

SEQ ID NO: 95 - DNA, 887 bp, human metapneumo virus
atggaggtgaaagtagagaacatccgagcagtagacatgctcaaagcaagagttaaaaatcgtgtggcacgcagcaaatgctttaaaaatgcctctttaatcctcgtaggaataactacactgagtatagccctcaatatctatctgatcgtaaactacacaatacaaaaaaccacatccgaatcagaacaccacactagctcatcacccacagaatccaacaaaggaacttcaacaatcccacagacaacccagacatcaatccaaattcacaacatccaactcaacagtccacagaaagccccacactcaacaccgcagcctcggtgagcccatcagaaacagaaccagcatcaacaccagacacaacaaaccgcctgtcctccgcagacagatccacaacacaaccaagtgaaagcagaacaaagacaaagctgacagtccacacaaaaaacaacctaagtacagcctccagaacacaatcaccaccacgggcaacaacgaaggcggtcctcagagacaccgccttccacacgagcagcacaggaaaaagaccaaccacaacatcagtccagtctggcagcagcaccacaactcaaaatcatgaagaaacaagttcatcgaacccacaggcatctgcaagcacaatgcaagaccaggacaccaacaatacaaaacaaaattagttaacaaaaaatacaagatagctctaaagtaaaacatgtaggtaccaacagtaaagaaatcaaaagacaactcataatctccccaaaacagcaacaacatcatgtcagcttcgctcaaatctccctgggagaaactctcgcccacatactaacaacatcacaactatctcaagaaaagaaactgggcaaaaaaacactcaa

SEQ ID NO: 96 - DNA, 888 bp, human metapneumo virus
atggaggtgaaagtagagaacattcgagcaatagacatgctcaaagcaagaatgaaaaatcgtgtggcacgcagcaaatgctttaaaaatgcttctttaatcctcataggaataactactctgagtatagccctcaatatctatctgatcataaactacacaatacaaaaaaccacatctgaatcagaacaccacactagctcaccacccacagaatccaacaaagaaacttcaacaatccctatagacaacccagacatcaatccaaactcacagcatccaactcaacagtccacagaaagcctcacactcaaccccgcagcctcggtgagcccatcagaaacagaaccagcatcaacaccagacacaacaaaccgcctgtcctccgtagacagatccacaacacaaccaagtgaaagcagaacaaagacaaaactgacagtccacaaaaaaaacatcccaagtacagtctctagaacacaatcctcaatacgggcaacaacgaaggcggtcctcagagccaccgcctttcgcacgagcagcacaggagaaagaccaactacaacatcagtccagtctgacagcagcaccacaacccaaaatcatgaagaaacaggttcagcgaacccacaggcatctgcaagcacaatgcaaaactagcacaccaacattgtaaaaccaaattagttaacaaaaaatatgaaatagctctaaagtaaaacatgtaggtgctaacaatcaagaaatcaaaagacatctcataatctctccaaaacagcaacaacatcatgtcaactttgctcaaatctccctgggagaaactttcgcccccatactgacaacatcacaatcatctcaagaaaagaaactgggcaaaacagcaccaaa

SEQ ID NO: 97 - DNA, 888 bp, human metapneumo virus
atggaggtgaaagtagagaacattcgagcaatagacatgctcaaagcaagagtgaaaaatcgtgtggcacgcagcaaatgctttaaaaatgcttctttaatcctcataggaataactactctgagtatagccctcaacatctatctgatcataaactacacaatacaaaaaaccacatctgaatcagaacaccacactagctcaccacccacagaatctaacaaagaaacttcaacaatctctatagacaacccagacatcaatccaaactcacagcatccaactcaacagtccacagaaagcctcacactcagccccacagcctcggtgagcccatcagaaacagaaccagcatcaacatcagacacaacaagccgcctgtcttccgtagacagatccacaacacaaccaagtgaaagcagagcaaggacaaaaccgacagtccacaagaaaaacatcccaagtacagtttctagaacacaatccccactacgggcaacaacgaaggcggtcctcagagccaccgcctttcgcacgagcagcacaggagagggaccaaccacaacatcggtccagtctgacagcagcaccacaacccaaaatcatgaagaaacaggttcagcgaacccacaggcatctgcaagcacaatgcaaaactagcacaccaacattgtaaaaccaaattagttaacaaaaaatatgaaatagttctaaagtaaaacatgtaggtgctaacaatcaagaaatcaaaagacaactcataatctccctaaaacagcaacaacatcatgtcaactttgctcaaatctccctgggagaaactttcgcccccatactgacaacatcacaatcatctcaagaaaagaaactgggcaaaacagcaccaaa

SEQ ID NO: 98 - DNA, 888 bp, human metapneumo virus
atggaggtgaaagtagagaacattcgagcaatagacatgctcaaagcaagagtgaaaaatcgtgtggcacgtagcaaatgctttaaaaatgcttctttaatcctcataggaataactacactgagtatagctctcaatatctatctgatcataaactacacaatacaaaaaaccacatctgaatcagaacaccacaccagctcaccacccacagaatccaacaaggaagcttcaacaatctccacagacaatccagacatcaatccaaactcacagcatccaactcaacagtccacagaaaaccccacactaaaccccgcagcatcggtgagctcatcagaaacagaaccagcatcaacaccagacacaacaaaccgcctgtcctccgtagacaggtccacagcacaaccaagtgaaagcagaacaaagacaaaaccgacagtccacacaagaaacaacccaagcacagcttccagcacacaatccccaccacgggtaacaacgaaggcaatcctcagagccaccgtcttccgcatgagcagcacaggaaaaagaccagccacaacattagtccagtccgacagcagcaccacaacccaaaatcatgaagaaacaggttcagcaaactcacaggcatctgcaagcacaatgcaaaactagcactccaacaatataaaaccaaattagttaacaaaaaatacgagatagctctaaagtaaaacatgtaggcaccaacaatcaggaaattaaaagacaactcacaacctccctaaaacagcaacgacaccatgtcaactttgctcaaatctctctgggagaaacttttgcccacatactaacaacatcacaatcatctcaagaaaagaaactgggcaaaacagcatccaa

SEQ ID NO: 99 - DNA, 888 bp, human metapneumo virus
atggaggtgaaagtagagaacattcgagcaatagacatgctcaaagcaagagtgaaaaatcgtgtggcacgcagcaaatgctttaaaaatgcttctttaatcctcataggaataactactctgagtatagccctcaacatctatctgatcataaactacacaatacaaaaaaccacatctgaatcagaacaccacactagctcaccacccacagaatctaacaaagaaacttcaacaatctctatagacaactcagacatcaatccaaactcacagcatccaactcaacagtccacagaaagcctcacactcagccccacagcctcggtgagcccatcagaaacagaaccagcatcaacatcagacacaacaaaccgcctgtcttccgtagacagatccacaacacaaccaagtgaaagcagagcaagaacaaaaccgacagtccacaagaaaaacatcccaagtacagtttctagaacacaatccccactacgggcaacaacgaaggcggtcctcagagccaccgcctttcgcatgagcagcacaggagagggaccaaccacaacatcggtccagtctgacagcagcaccacaacccaaaatcatgaagaaacaggctcagcgaacccacaggcatctgcaagcacaatgcaaaaccagcacaccaacattgcaaaaccaaattagttaacaaaaaatatgaaatagttctaaagtaaaacatgtaggtgccaacaatcaagaaatcaaaagacaactcacaatctccctaaaacagcaacaacatcatgccaactttgctcaaatctccctgggagaaaccctcgcccccatactgacaacatcacaatcatctcaagaaaagaaactgggcaaaacagcaccaaa

SEQ ID NO: 100 - DNA, 888 bp, human metapneumo virus
atggaggtgaaagtagagaacattcgagcaatagacatgctcaaagcaagagtgaaaaatcgtgtggcacgcagcaaatgctttaaaaatgcttctttaatcctcataggaataactactctgagtatagccctcaatatctatctgatcataaactacacaatacaaaaaaccacatctgaatcagaacaccacactagctcaccacccacagaatctaacaaggaaacttcaacaatccctatagacaacccagacatcaatccaaactcacagcatccaactcaacagtccacagaaagcctcacactctaccccacatcctcggtgagctcatcagaaacagaaccagcatcaacaccaggcataacaaaccacctgtcctttgtagacagatccacaacacaaccaagtgaaagcagaacaaagacaaaccggacagtccacaaaaaaaacatctcaagtacagtttctagaacacagtccccaccacggacaacagcgaaggcggtccccagagccaccgcccttcgcacgagcagcacaggagaaagaccaaccacaacaccagtccagcccgatagcagcaccacaacacaaaatcatgaagaaacaggctcagcgaacccacaggcatccgcaagcacaatgcaaaaccagcacaccaacattgcaagaccaaattagttaacaaaaaatatgaaatagctctaaagtaaaacatgtaggtgccaacaatcaagaaatcaaaagataactcataatctctctaaaacatcaacaacatcatgttaactttgctcaaatctctctgggagaaaccttcgcccccatactggcaacatcacaatcatctcaagaaaagaaactgggcaaaacaacaccaaa

SEQ ID NO: 101 - DNA, 888 bp, human metapneumo virus
atggaggtgaaagtagagaacattcgagcaatagacatgctcaaagcaagagtgaaaaatcgtgtggcacgcagcaaatgctttaaaaatgcttctttaatcctcataggaataactactctgagtatagccctcaatatctatctgatcataaactacacaatacaaaaaaccacatctgaatcagaacaccacactagctcaccacccacagaatctaacaaggaaacttcaacaatccctatagacaacccagacatcaatccaaactcacagcatccaactcaacagtccgcagaaagcctcacactctaccccacatcctcggtgagctcatcagaaacagaaccagcatcaacaccaggcataacaaaccacctgtcctttgtagacagatccacaacacaaccaagtgaaagcagaacaaagacaaaccggacagtccacaaaaaaaacatctcaagtacagtttctagaacacagtccccaccacggacaacagcgaaggcggtccccagagccaccgcccttcgcacgagcagcacaggagaaagaccaaccacaacaccagtccagcccgatagcagcaccacaacacaaaatcatgaagaaacaggctcagcgaacccacaggcatccgcaagcacaatgcaaaaccagcacaccaacattgcaagaccaaattagttaacaaaaaatatgaaatagctctaaagtaaaacatgtaggtgccaacaatcaagaaatcaaaagataactcataatctctctaaaacatcaacaacatcatgttaactttgctcaaatctctctgggagaaaccttcgcccccatactggcaacatcacaatcatctcaagaaaagaaactgggcaaaacaacaccaaa

SEQ ID NO: 102 - DNA, 888 bp, human metapneumo virus
atggaggtgaaagtagagaatattcgagcaatagacatgctcaaagcaagagtgaaaaatcgtgtggcacgcagcaaatgctttaaaaatgcttctttaatcctcataggaataactactctgagtatagccctcaatatctatctgatcataaactacacaatacaaaaaaccacatctgaatcagaacaccacactagctcaccacccacagaatctaacaaggaaacttcaacaatccctatagacaacccagacatcaatccaaactcacagcatccaactcaacagtccacagaaagcctcacactctaccccacatcctcggtgagctcatcagaaacagaaccagcatcaacaccaggcataacaaaccacctgtcctttgtagacagatccacaacacaaccaagtgaaagcagaacaaagacaaaccggacagtccacaaaaaaaacatctcaagtacagtttctagaacacagtccccaccacggacaacagcgaaggcggtccccagagccaccgcccttcgcacgagcagcacaggagaaagaccaaccacaacaccagtccagcccgatagcagcaccacaacacaaaatcatgaagaaacaggctcagcgaacccacaggcatccgcaagcacaatgcaaaaccagcacaccaacattgcaagaccaaattagttaacaaaaaatatgaaatagctctaaagtaaaacatgtaggtgccaacaatcaagaaatcaaaagataactcataatctctctaaaacatcaacaacatcatgttaactttgctcaaatctctctgggagaaaccttcgcccccatactggcaacatcacaatcatctcaagaaaagaaactgggcaaaacaacacccaa

SEQ ID NO: 103 - DNA, 888 bp, human metapneumo virus
atggaggtgaaagtagagaacattcgagcaatagacatgctcaaagcaagagtgaaaaatcgtgtggcacgtagcaaatgctttaaaaatgcttctttaatcctcataggaataactacactgagcatagccctcaatatctatctgatcataaactacacaatacaacaaaccacatctgaatcagaacaccacaccagctcaccacccacagaatccaacaaggaagcttcaacaatctccacagacaacccagacatcaatccaaactcacagcatccaactcaacagtccacagaaaaccccacactcaacccagcagcatcagcgagcccatcagaaacagaatcagcatcaacaccagatacaacaaaccgcctgtcctccgtagacaggtccacggtacaaccaagtgaaaacagaacaaagacaaaactgacagtccacacaagaaacaacctaagcacagcctccagtacacaatccccaccacgggcaacaacgaaggcaatccgcagagccaccaccctccgcatgagcagcacaggaagaagaccaaccacaacactagtccagtccgacagcagcaccacaacccaaaatcatgaagaaacaggctcagcgaacccacaggcatctgcaagcacaatgcaaaaccagcacaccaacaatataaaaccaaattagttaacaaaaaatacgagatagctctaaagtaaaacatgtaggcaccaacaatcaagaaaccaaaagataactcacaatccccccaaaacagcaacgacaccatgtcagctttgctcaaatctctctgggagaaacttttgcccacatactaacaacatcacaaccatctcaagaaaagaaactgggcaaaacagcatccaa

SEQ ID NO: 104 - DNA, 888 bp, human metapneumo virus
atggaggtgaaagtagagaacattcgagcaatagacatgctcaaagcaagagtgaaaaatcgtgtggcacgtagcaaatgctttaaaaatgcttctttaatcctcataggaataactacactgagcatagccctcaatatctatctgatcataaactacacaatacaaaaaaccacatctgaatcagaacaccacaccagctcaccacccacagaatccaacaaggaagcttcaacaatctccacagacaacccagacatcaatccaaactcacagcatccaactcaacagtccacagaaaaccccacactcaacccagcagcatcagcgagcccatcagaaacagaatcagcatcaacaccagatacaacaaaccgcctgtcctccgtagacaggtccacggtacaaccaagtgaaaacagaacaaagacaaaactgacagtccacacaagaaacaacctaagcacagcctccagtacacaatccccaccacgggcaacaacgaaggcaatccgcagagccaccaccctccgcatgagcagcacaggaagaagaccaaccacaacactagtccagtccgacagcagcaccacaacccaaaatcatgaagaaacaggctcagcgaacccacaggcatctgcaagcacaatgcaaaaccagcacaccaacaatataaaaccaaattagttaacaaaaaatacgagatagctctaaagtaaaacatgtaggcaccaacaatcaagaaaccaaaagataactcacaatccccccaaaacagcaacgacaccatgtcagctttgctcaaatctctctgggagaaacttttgcccacatactaacaacatcacaaccatctcaagaaaagaaactgggcaaaacagcatccaa

SEQ ID NO: 105 - DNA, 901 bp, human metapneumo virus
atggaagtaagagtggagaacattcgagcgatagacatgttcaaagcaaagataaaaaaccgtataagaagcagcaggtgctatagaaatgctacactgatccttattggactaacagcgttaagcatggcacttaatattttcctgatcatcgatcatgcaacattaagaaacatgatcaaaacagaaaactgtgctaacatgccgtcggcagaaccaagcaaaaagaccccaatgacctccacagcaggcccaaacaccaaacccaatccacagcaagcaacacagtggaccacagagaactcaacatccccagtagcaaccccagagggccatccatacacagggacaactcaaacatcagacacaacagctccccagcaaaccacagacaaacacacagcaccgctaaaatcaaccaatgaacagatcacccagacaaccacagagaaaaagacaatcagagcaacaacccaaaaaagggaaaaaggaaaagaaaacacaaaccaaaccacaagcacagctgcaacccaaacaaccaacaccaccaaccaaatcagaaatgcaagtgagacaatcacaacatccgacagacccagaactgacaccacaacccaaagcagcgaacagacaacccgggcaacagacccaagctccccaccacaccatgcatagagaggtgcaaaactcaaatgagcacaacacacaaacatcccatccaagtagttaacaaaaaaccacaaaataaccttgaaaaccaaaaaaccaaaacataaacccagacccagaaaaacatagacaccatatggaaggttctagcatatgcaccaatgagatggcatctgttcatgtatcaatagcaccaccatcattcaaggaataagaagaggcgaaaatttaa

SEQ ID NO: 106 - DNA, 901 bp, human metapneumo virus
atggaagtaagagtggagaacattcgagcgatagacatgttcaaagcaaagataaagaaccgtataagaagcagcaggtgctatagaaatgctacactgatccttattggactaacagcgttaagcatggcacttaatattttcctgatcattgatcatgcaacattaagaaacatgatcaaaacagaaaactgtgctaacatgccatcggcagaaccaagcaaaaagaccccaatgacctccacagcaggcccaagcaccgaacccaatccacagcaagcaacacaatggaccacagagaactcaacatccccagcagcaaccctagagagccatccatacacagggacaacccaaacaccagacataacagctccccaacaaaccacagacaaacacacagcactgccaaaatcaaccaatgaacagatcacccagacaaccacagagaaaaagacaaccagagcaacaacccaaaaaagggaaaaagaaaaagaaaacacaaaccaaaccacaagcacagctgcaacccaaacaaccaacaccaccaaccaaaccagaaatgcaagtgagacaatcacaacatccgacagacccagaattgacaccacaacccaaagcagcgatcagacaacccgggcaacagacccaagctccccaccacaccatgcacagagtggtgcaaaacccaaatgaacacaacacacaaacatctcatccaagtagttaacaaaaaaccacaaaataaccttgaaaaccaaaaaaccaaaccacaaacttagacccagaaaaacatagacactatatggaaggtttgagcatatgcaccaatgaaatggtatctgttcatgtatcaatagcgccaccattatttaaggaataagaagaggcaaaaattcaa

SEQ ID NO: 107 - DNA, 860 bp, human metapneumo virus
atggaagtaagagtggagaacattcgagcgatagacatgttcaaagcaaagataaaaaaccgtataagaagcagcaggtgctatagaaatgctacactgatccttattggactaacagcgttaagcatggcacttaatattttcctgatcatcgatcatgcaacattaagaaacatgatcaaaacagaaaattgtgctaacatgccgccggcagaaccaagcaaaaagaccccaatgacctctacagcaggcccaaacaccaaacccaatccacagcaagcaacacagtggaccacggagaactcaacattcccagcagcaacctcagagggccatctacacacagggacaactcaaacaccagacacaacagctcctcagcaaaccacagacaaacacacagcactgccaaaatcaaccaatgaacaaatcacccagacaaccacagagaaaaagacaaccagagcaacaacccaaagaagggaaaaagggaaagaaaacacaaaccaaaccacaagcacagctgctacccaaacaaccaacaccaccaaccaaatcagaaatgcaagcgagacaatcacaacatccgacagacccagaactgactccacaacccaaagcagcgaacagacaacccgggcaacagacccaagctccccaccacatcatgcacagggaagtgcaaaacccaaatgaacacaacacacaaacatcccatccaagtagttaacaaaaaatcagacccagaaaaacatagacactatatggaaggtccgagcatatgcaccgatgaaatggcatttgttcatgtatcaatagcgccaccattatttaaggaataagaagaggcaaaaattcaa

SEQ ID NO: 108 - DNA, 861 bp, human metapneumo virus
atggaagtaagagtggagaacattcgagcgatagacatgttcaaagcaaagataaaaaaccgtataagaagcagcaggtgctatagaaatgctacactgatccttattggactaacagcgttaagcatggcacttaatattttcctgatcatcgatcatgcaacattaagaaacatgatcaaaacagaaaattgtgctaacatgccgccggcagaaccaagcagaaagaccccaatgacctccacagcaggcccaaacaccaaacccaatccacagcaagcaacacagtggaccacggagaactcaacatccccagcagcaaccccagagggccatctacacacagggacaactcaaacaccagacacaacagctcctcagcaaaccacagacaaacacacagcactgccaaaatcaaccaatgaacagatcacccaggcaaccacagagaaaaagacaaccagagaaacaacccaaagaagggaaaaaggaaaagaaaacacaaaccaaaccacaagcacagctgcaacccaaacaaccaacaccaccaaccaaatcagaaatgcaagcgagacaatcacaacatccgacagacccagaactgactccacaacccaaagcagcgaacagacaacccaggcaacagacccaagctccccagcacaccatgcacagggaagtgcaaaacccaaatgaacacaacacacaaacatcccatccaagtagttaacaaaaaaatcagacccagaaaaacacagacactatatggaaggtccgagcatatgcaccgatgaaatggcatctgttcatgtatcaatagcaccaccattatttaaggaataagaagaggcaaaaattcaa

SEQ ID NO: 109 - DNA, 860 bp, human metapneumo virus
atggaagtaagagtggagaacattcgagcgatagacatgttcaaagcaaagataaaaaaccgtataagaagcagcaggtgctatagaaatgctacattgatccttattggactaacagcgttaagcatggcacttaatattttcctgatcatcgatcatgcaacattaagaaacatgatcaaaacagaaaattgtgctaacatgccaccggcagaaccaagcaaaaagaccccaatgacctccacagcaggcctaaacactaaacccaatccacagcaagcaacacagtggaccacggagaactcaacatccccagcagcaaccccagagggccatctacacacagggacaactcaaacaccagacacaacagctcctcagcaaaccacagacaagcacacagcactgccaaaatcaaccaatgaacagatcacccagacaaccacagagaaaaagacaaccagagcaacaacccaaagaagggaaaaaggaaaagaaaacacaaaccaaaccacaagcacagctgcaacccaaacaaccaacaccaccaaccaaatcagaaatgcaagcgagacaatcacaacatccgacagacccagaactgactccacaacccaaagcagcgaacagacaacccgggcaacagacccaagctccccaccacaccatgcacagggaagtgcaaaacccaaatgaacacaacacacaaacatcccatccaagtagttaacaaaaaatcagacccagaaaaacatagacactatatggaaggtccgagcatatgcaccgatgaaatggcatctgttcatgtatcaatagcgccaccattatttaaggaataagaagaggcaaaaattcaa

SEQ ID NO: 110 - DNA, 860 bp, human metapneumo virus
atggaagtaagagtggagaacattcgagcgatagacatgttcaaagcaaagataaaaaaccgtataagaagcagcaggtgctatagaaatgctacactgatccttattggactaacagcgttaagcatggcacttaatattttcctgatcatcgatcatgcaacattaagaaacatgatcaaaacagaaaattgtgctaacatgccgccggcagaaccaagcaaaaagaccccaatgacctccacagcaggcccaaacaccaaacccaatccacagcaagcaacacagtggaccacggagaactcaacatccccagcagcaaccccagagggccatctacacacagggacaactcaaacaccagacacaacagctcctcagcaaaccacagacaaacacacagcactgccaaaatcaaccaatgaacagatcacccagacaaccacagagaaaaagacaaccagagcaacaacccaaagaagggaaaaaggaaaagaaaacacaaaccaaaccacaagcacagctgcaacccaaacaaccaacaccaccaaccaaatcagaaatgcaattgagacaatcacaacatccgacagacccagaactgactccacaacccaaagcagcgaacagacaacccgggcaacagacccaagctcccacccacaccatgcacagggaagtgcaaaacccaaatgaacacaacacacaaacatcccatccaagtagttaacaaaaaatcagacccagaaaaacatagacactatatggaaggtccgagcatatgcaccgatgaaatggcatctgttcatgtatcaatagcgccaccattatttaaggaataagaagaggcaagaattcaa

SEQ ID NO: 111 - DNA, 886 bp, human metapneumo virus
atggaagtaagagtggagaacattcgggcaatagacatgttcaaagcaaaaatgaaaaaccgtataagaagtagcaagtgctatagaaatgctacactgatccttattggattaacagcattaagtatggcacttaatatttttttaatcattgattatgcaatgttaaaaaacatgaccaaagtggaacactgtgttaatatgccgccggtagaaccaagcaagaagaccccaatgacctctgcagtagacttaaacaccaaacccaatccacagcaggcaacacagttggccgcagaggattcaacatctctagcagcaacctcagaggaccatctacacacagggacaactccaacaccagatgcaacagtctctcagcaaaccacagacgagtacacaacattgctgagatcaaccaacagacagaccacccaaacaaccacagagaaaaagccaaccggagcaacaaccaaaaaagaaaccacaactcgaactacaagcacagctgcaacccaaacactcaacactaccaaccaaactagctatgtgagagaggcaaccacaacatccgccagatccagaaacagtgccacaactcaaagcagcgaccaaacaacccaggcagcagacccaagctcccaaccacaccatacacagaaaagcacaacaacaacatacaacacagacacatcctctccaagtagttaacaaaaaaactataaaataatcatgaaaaccgaaaaactagaaaagttaatttgaactcagaaaagaacacaaacactatatgaattgtttgagcgtatatactaatgaaatagcatctgtttgtgcatcaataataccatcattatttaagaaataagaagaagctaaaattcaa

SEQ ID NO: 112 - DNA, 889 bp, human metapneumo virus
atggaagtaagagtggagaacattcggacaatagacatgttcaaagcaaagatgaaaaaccgtataagaagcagcaagtgctatagaaatgctacactgatccttattggactgacagcattaagtatggcacttaatattttcttgatcatcgattatgcaacatttaaaaacatgaccaaagtggaacactgtgctaatatgccgccggtagaaccgagtaagaagaccccaatgacctctacagtagactcaagcaccggacccaatccacagcagacaacacagtggaccacagaggattcaacatctctagcagcaacctcagaggaccatctacacacagggacaactccaacactagatgcaacagtttctcagcaaaccccagacaagcacacaacaccgctgagatcaaccaatggacagaccacccagacaaccacagagaaaaagccaaccagagcaatagccaaaaaagaaaccacaaaccaaaccacaagcacagctgcaacccaaacattcaacaccaccaatcaaaccagaaatggaagagagacaaccataacatctgccagatccagaaacgacgccacaactcaaagcagcgaacaaacaaaccagacaacagacccaagctcccaaccacatcatgcatagataagcacaataacaatatgaacacaacacagacacatcttctccaagtagttaacaaaaaactataaaataaccatgaaaaccaaaaaactagaaaagtaaatttgaactcagaaaagaacacaaacactaaatgaattgtttgagcatatatactaatgaaatagcatctgttcatgcatcaataataccatcattacttaagaaataagaagaagcaaaaattcaa

SEQ ID NO: 113 - DNA, 885 bp, human metapneumo virus
atggaagtaagagtggagaacattcgggcaatagacatgttcaaagcaaagatgaaaaaccgtataagaagtagcaagtgctatagaaatgctacactgatccttattggattaacagcattaagtatggcacttaatatttttttaatcattgattatgcaatgttaaaaaacatgaccaaagtggaacactgtgttaatatgccgccggtagaaccaagcaagaagaccccaatgacctctgcagtagacttaaacaccaaactcaatccacagcaggcaacacagttgaccacagaggattcaacatctctagcagcaacctcggaggatcatttactcacagggacaactccaacaccagatgcaacagtctctcagcaaaccacagacgagcacacaacactgctgagatcaaccaacagacagaccacccaaacaaccacagagaaaaagccaaccggagcaacaaccaaaaaagaaaccacaactcgaaccacaagcacagctgcaacccaaacactcaacaccaccaaccaaactagcaatggaagagaggcaaccacaacatccaccagatccagaaacggtgccacaactcaaaacagcgatcaaacaacctagacagcagacccaagctcccaaccacaccatacacagaaaagcacaacaacaacatacaacacagacacatcttctccaagtagttaacaaaaaactataaaataaccatgaaaactaaaaaactagaaaagttaatttgaactcagaaaagaacacaaacactatatgaattgtttgagcgtatatactaatgaaatagcatctgtttgtgcatcaataataccatcattatttaagaaataagaagaagctaaaattcaa

SEQ ID NO: 114 - DNA, 885 bp, human metapneumo virus
atggaagtaagagtggagaacattcgggcaatagacatgttcaaagcaaagatgaaaaaccgcataagaagtagcaagtgctatagaaatgctacactgatccttattggattaacagcattaagtatggcacttaatatttttttaatcattgattatgcaacattaaaaaacatgaccaaagtggaacactgtgttaatatgccgccggtagaaccaagcaagaagaccccaatgacctctgcagtagacttaaacaccaaactcaatccacagcaggcaacacagttgaccacagaggattcaacatctctagcagcaacctcagagggccatccacacacaggaacaactccaacaccagacgcaacagtctctcagcaaaccacagacgagcacacaacactgctgagatcaaccaacagacagaccacccaaacagccacagagaaaaagccaactggagcaacaaccaaaaaagaaaccacaacccgaactacaagtacagctgcaacccaaacacccaacaccaccaaccaaaccagcaatggaagagaggcaaccacaacatccgccaggtccagaaacggtgccacaactcaaaacagcgatcaaataacccaggcagcagactcaagctcccaaccacaccatacacagaaaagcacaacaacagcatacaacacagacacatcttttccaagtagttaacaaaaaactataaaataaccatgaaaaccaaaaaactagaaaagttaatttgaactcagaaaagaacacaaacactatatgaattgtttgagcgtatatactaatgaaatagcatctgtttgtgcatcaataataccatcattatttaagaaataagaagaagctaaaattcaa

SEQ ID NO: 115 - DNA, 886 bp, human metapneumo virus
atggaagtaagagtggagaacattcgggcaatagacatgttcaaagcaaagatgaaaaaccgtataagaagtagcaagtgctatagaaatgctacactgatccttattggattaacagcactaagtatggcacttaatatttttttaatcattgattatgcaacattaaaaaacatgaccaaagtggaacactgtgttaatatgccgccggtagaaccaagcaagaagaccccaatgacctctgcagtagactcaaacaccaaacccaatccacagcaggcaacacagttgaccacagaggattctacatctttagcagcaaccctagaggaccatccacacacagggacaactccaacaccagatgcaacagtctctcagcaaaccacagacgagcacacaacactgctgagatcaaccaacagacagaccacccaaacaactgcagagaaaaagccaaccagggcaacaaccaaaaaagaaaccacaactcgaaccacaagcacagctgcaacccaaacactcaacaccaccaaccaaactagcaatggaagagaggcaaccacaacatctgccagatccagaaacaatgccacaactcaaagcagcgatcaaacaacccaggcagcagaaccaagctcccaatcacaacatacacagaaaagcacaacaacaacatacaacacagacacatcttctctaagtagttaacaaaaaaactataaaataaccatgaaaaccaaaaaactagaaaagttaatttgaactcagaaaagaacacaaacactatatgaattatttgagcgtatatactaatgaaatagcatctgtttgtgcatcaataataccatcattatttaagaaataagaagaagctaaaattcaa

SEQ ID NO: 116 - DNA, 887 bp, human metapneumo virus
atggaagtaagagtggagaacattcgggcaatagacatgttcaaagcaaagatgaaaaaccgtataagaagtagcaagtgctatagaaatgctacactgatccttattggattatcagcactaagtatggcacttaatatttttttaatcattgattatgcaaaatcaaaaaacatgaccagagtggaacactgtgtcaatatgccgccggtagaaccaagcaagaagaccccaatgacctctgcagtagacttaaacaccaaacccaatccacagcgggcaacacagttgaccacagaggattcaacatctctagcagcaaccctagagggccatctacacacagggacaactccaacaccagatgtaacagtctctcagcaaaccacagacgagcacacaacactgctgagatcaaccaacagacagaccacccaaacagccgcagagaaaaagccaaccagagtaacaactaacaaagaaaccataactcgaaccacaagcacagccgcaacccaaacactcaacaccaccaaccaaaccaacaatggaagagaggcaaccacaacatctgccagatccagaaacaatgccacaactcaaagcagcgaccaaacaacccaggcagcagacccaagctcccaatcacaacatacacagaaaagcataacaacaacatacaacacagacacatcttctccaagtagttaacaaaaaaactataaaataaccatgaaaaccaaaaaaactagaaaagttaatttgaactcagaaaagaacacaaacactatatgaattgtttgagcgtatatactaatgaaatagcatctgtttgtgcatcaataataccatcattatttaagaattaagaagaagctaaaattcaa

SEQ ID NO: 117 - DNA, 887 bp, human metapneumo virus
atggaagtaagagtggagaacattcgggcaatagacatgttcaaagcaaagatgaaaaaccgtataagaagtagcaagtgctatagaaatgctacactgatccttattggattatcagcactaagtatggcacttaatatttttttaatcattgattatgcaaaatcaaaaaccatgaccagagtggaacactgtgttaatatgccgccggtagaaccaagcaagaagaccccaatgacctctgcagtagacttaaacaccaaacccaatccacagcaggcaacacagttgaccacagaggattcaacatctccagcagcaaccctagagggccatctacacacagggacaactccaacaccagatgcaacagtctctcagcaaaccacagacgagcacacaacactgctgagatcaaccaacagacagaccacccaaacaaccgcagagaaaaagccaaccagagcaacaaccaaaaaagaaaccataactcgaaccacaagcacagctgcaacccaaacactcaacaccaccaaccaaaccagcaatggaagagaggcaaccacaacatctgccagatccagaaacaatgccacaactcaaagcagcgaccaaacaacccaggcagcagacccaagctcccaatcacaacatacaaagaaaagcacaacaacaacatacaacacagacacatcttctccaagtagttaacaaaaaaactataaaataaccatgaaaaccaaaaaaactagaaaagttaatttgaactcagaaaagaacacaaacactatatgaattgtttgagcgtatatactaatgaaatagcatctgtttgtgcatcaataataccatcattatttaagaattaagaagaagctaaaattcaa

SEQ ID NO: 118 - DNA, 886 bp, human metapneumo virus
atggaagtaagagtggagaacattcgggcaatagacatgttcaaagcaaagatgaaaaaccgtataagaagtagcaagtgctatagaaatgctacactgatccttattggattaacagcactaagtatggcacttaatatttttttaatcattgattatgcaacattaaaaaacatgaccaaagtggaacactgtgttaatatgccgccggtagaaccaagcaagaagaccccaatgacctctgcagtagacttaaacaccaaacccaatccacagcaggcaacacagttgaccacagaggactctacatctttagcagcaaccctagaggaccatccacacacagggacaactccaacaccagatgcaacagtctctcagcaaaccacagacgagcacacaacactgctgagatcaaccaacagacagaccacccaaacaactgcagagaaaaagccaaccagagcaacaaccaaaaaagaaaccacaactcgaaccacaagcacagctgcaacccaaacactcaacaccaccaaccaaactagcaatggaagagaggcaaccacaacatctgccagatccagaaacaatgccacaactcaaagcagcgatcaaacaacccaagcagcagaaccaaactcccaatcacaacatacacagaaaagcacaacaacaacatacaacacagacacatcttctctaagtagttaacaaaaaaactataaaataaccatgaaaaccaaaaaactagaaaagttaatttgaactcagaaaggaacacaaacactatatgaattatttgagcgtatatactaatgaaatagcatctgtttgtgcatcaataataccatcattatttaagaaataagaagaagctaaaattcaa

SEQ ID NO: 119 - protein, 236 aa, human metapneumo virus
MEVKVENIRTIDMLKARVKNRVARSKCFKNASLVLIGITTLSIALNIYLIINYKMQKNTSESEHHTSSSPMESSRETPTVPTDNSDTNSSPQHPTQQSTEGSTLYFAASASSPETEPTSTPDTTNRPPFVDTHTTPPSASRTKTSPAVHTKNNPRTSSRTHSPPRATTRTARRTTTLRTSSTRKRPSTASVQPDISATTHKNEEASPASPQTSASTTRIQRKSVEANTSTTYNQTS

SEQ ID NO: 120 - protein, 236 aa, human metapneumo virus
MEVKVENIRTIDMLKASVKNRVARSKCFKNASLVLIGITTLSIALNIYLIINYKMQKNTSESEHHTSSSPMESSRETPTVPTDNSDTNSSPQHPTQQSTEGSTLYFAASASSPETEPTSTPDTTNRPPFVDTHTTPPSASRTKTSPAVHTKNNPRTSSRTHSPPRATTRTARRTTTLRTSSTRKRPSTASVQPDISATTHKNEEASPASPQTSASTTRIQRKSVEANTSTTYNQTS

SEQ ID NO: 121 - protein, 236 aa, human metapneumo virus
MEVKVENIRTIDMLKARVKNRVARSKCFKNASLVLIGITTLSIALNIYLIINYKMQKNTSESEHHTSSSPMESSRETPTVPTDNSDTNSSPQHPTQQSTEGSTLYFAASANSPETEPTSTPDTTNRPPFVDTHTTPPSASRTKTSPAVHTKNNPRISSRTHSPPWATTRTARRTTTLRTSSTRKRPSTASAQPDISATTHKNEEASPASPQTSASTTRTQRKSVEANTSTTYNQTS

SEQ ID NO: 122 - protein, 236 aa, human metapneumo virus
MEVKVENIRTIDMLKARVKNRVARSKCFKNASLVLIGITTLSIALNIYLIINYKMQKNTSESEHHTSSSPMESSRETPTVPTDNSDTNSSPQHPTQQSTEGSTLYFAASANSPETEPTSTPDTTDRPPFVDTHTTPPSASRTKTSPAVHTKNNPRISSRTHSPPWATTRTARRTTTLRTSSTRKRPSTASVQPDISATTHKNEEASPASPQTSASTTRTQRKSVEANTSTTYNQTS

SEQ ID NO: 123 - protein, 236 aa, human metapneumo virus
MEVKVENIRTIDMLKARVKNRVARSKCFKNASLVLIGITTLSIALNIYLIINYKMQKNTSESEHHTSSSPMESSRETPTVPTDNSDTNSSPQHPTQQSTEGSTLYFAASASSPETEPTSTPDTTDRPPFVDTHTTPPSASRTKTSPAVHTKNNPRISSRTHSPPWATTRTARRTTTLRTSSTRKRPSTASVQPDISATTHKNEEASPASPQTSASTTRTQRKSVEANTSTTYNQTS

SEQ ID NO: 124 - protein, 236 aa, human metapneumo virus
MEVKVENIRTIDMLKARVKNRVARSKCFKNASLILIGITTLSIALNIYLIINYTMQENTSESEHHTSSSPMESSRETPTVPIDNSDTNPGSQYPTQQSTEDSTLHSAASASSPETEPTSTPDTTSRPPFVDTHTTPPSASRTRTSPAVHTKNNPRVSPRTHSPPWAMTRTVRGTTTLRTSSTRKRLSTASVQPDSSATTHKHEETSPVSPQTSASTARPQRKGMEASTSTTYNQTS

SEQ ID NO: 125 - protein, 236 aa, human metapneumo virus
MEVKVENIRTIDMLKARVKNRVARSKCFKNASLILIGITTLSIALNIYLIINYTMQENTSESEHHTSSSPMESSRETPTVPMDNSDTNPGSQYPTQQSTEGSTLHFAASASSPETEPTSTPDTTSRPPFVDTHTTPSSASRTKTSPAVHTKNNLRISPRTHSPPWAMTRTVRGTTTLRTSSIRKRPSTASVQPDSSATTHKHEEASPVSPQASASTARPQRKGMEASTSTTYNQTS

SEQ ID NO: 126 - protein, 236 aa, human metapneumo virus
MEVKVENIRTIDMLKARVKNRVARSKCFKNASLILIGITTLSIALNIYLIINYTMQENTSESEHHTSSSPMESSRETPTVPMDNSDTNPGSQYPTQQSTEGSTLHFAASASSPETEPTSTPDTTSRPPFVDTHTTPSSASRIRTSPAVHTKNNLRISPRTHSPPWAMTRTVRGTTTLRTSSIRKRPSTASVQPDSSATTHKHEEASPVSPQASASTARPQRKGMEASTSTTYNQTS

SEQ ID NO: 127 - protein, 228 aa, Human metapneumo virus
  VARIANT 220: Xaa = unknown amino acid or other
MEVKVENIRAIDMLKARVKNRVARSKCFKNASLILIGITTLSIALNIYLIINYTIQKTTSESEHHTSSPPTEPNKEASTISTDNPDINPSSQHPTQQSTENPTLNPAASASPSETEPASTPDTTNRLSSVDRSTAQPSESRTKTKPTVHTINNPNTASSTQSPPRTTTKAIRRATTFRMSSTGKRPTTTLVQSDSSTTTQNHEETGSANPQASASTMQNXHTNNIKPN

SEQ ID NO: 128 - protein, 228 aa, human metapneumo virus
MEVKVENIRAIDMLKARVKNRVARSKCFKNASLILIGITTLSIALNIYLIINYTIQKTTSESEHHTSSPPTESNKETSTIPIDNPDINPNSQHPTQQSTESPTLNPAASVSPSETEPASTPDTTNRLSSVDRSTTQPSESRTKTKPTVHTKNNPSTVSRTQSPLRATTKAVLRATAFRTSSTRKRPTTTSVQSDSSTTTQNHEETSSANPQASASTMQSQHTNNIKPN

SEQ ID NO: 129 - protein, 228 aa, human metapneumo virus
MEVKVENIRAVDMLKARVKNRVARSKCFKNASLILVGITTLSIALNIYLIVNYTIQKTTSESEHHTSSSPTESNKGTSTIPTDNPDINPNSQHPTQQSTESPTLNTAASVSPSETEPASTPDTTNRLSSADRSTTQPSESRTKTKLTVHTKNNLSTASRTQSPPRATTKAVLRDTAFHTSSTGKRPTTTSVQSGSSTTTQNHEETSSSNPQASASTMQDQDTNNTKQN

SEQ ID NO: 130 - protein, 228 aa, human metapneumo virus
  VARIANT 81: Xaa = Any Amino Acid
MEVKVENIRAVDMLKARVKNRVARSKCFKNASLILVGITTLSIALNIYLIVNYTIQKTTSESEHHTSSSPTESNKGTSTIXTDNPDINPNSQHPTQQSTESPTLNTAASVSPSETEPASTPDTTNRLSSADRSTTQPSESRTKTKLTVHTKNNLSTASRTQSPPRATTKAVLRDTAFHTSSTGKRPTTTSVQSGSSTTTQNHEETSSSNPQASASTMQDQDTNNTKQN

SEQ ID NO: 131 - protein, 228 aa, Human metapneumo virus
  VARIANT 220: Xaa = unknown amino acid or other
MEVKVENIRAIDMLKARMKNRVARSKCFKNASLILIGITTLSIALNIYLIINYTIQKTTSESEHHTSSPPTESNKETSTIPIDNPDINPNSQHPTQQSTESLTLNPAASVSPSETEPASTPDTTNRLSSVDRSTTQPSESRTKTKLTVHKKNIPSTVSRTQSSIRATTKAVLRATAFRTSSTGERPTTTSVQSDSSTTTQNHEETGSANPQASASTMQNXHTNIVKPN

SEQ ID NO: 132 - protein, 228 aa, Human metapneumovirus
  VARIANT 220: Xaa = unknown amino acid or other
MEVKVENIRAIDMLKARVKNRVARSKCFKNASLILIGITTLSIALNIYLIINYTIQKTTSESEHHTSSPPTESNKETSTISIDNPDINPNSQHPTQQSTESLTLSPTASVSPSETEPASTSDTTSRLSSVDRSTTQPSESRARTKPTVHKKNIPSTVSRTQSPLRATTKAVLRATAFRTSSTGEGPTTTSVQSDSSTTTQNHEETGSANPQASASTMQNXHTNIVKPN

SEQ ID NO: 133 - protein, 228 aa, Human metapneumovirus
  VARIANT 220: Xaa = unknown amino acid or other
MEVKVENIRAIDMLKARVKNRVARSKCFKNASLILIGITTLSIALNIYLIINYTIQKTTSESEHHTSSPPTESNKEASTISTDNPDINPNSQHPTQQSTENPTLNPAASVSSSETEPASTPDTTNRLSSVDRSTAQPSESRTKTKPTVHTRNNPSTASSTQSPPRVTTKAILRATVFRMSSTGKRPATTLVQSDSSTTTQNHEETGSANSQASASTMQNXHSNNIKPN

SEQ ID NO: 134 - protein, 228 aa, human metapneumo virus
MEVKVENIRAIDMLKARVKNRVARSKCFKNASLILIGITTLSIALNIYLIINYTIQKTTSESEHHTSSPPTESNKETSTISIDNSDINPNSQHPTQQSTESLTLSPTASVSPSETEPASTSDTTNRLSSVDRSTTQPSESRARTKPTVHKKNIPSTVSRTQSPLRATTKAVLRATAFRMSSTGEGPTTTSVQSDSSTTTQNHEETGSANPQASASTMQNQHTNIAKPN

SEQ ID NO: 135 - protein, 228 aa, human metapneumo virus
MEVKVENIRAIDMLKARVKNRVARSKCFKNASLILIGITTLSIALNIYLIINYTIQKTTSESEHHTSSPPTESNKETSTIPIDNPDINPNSQHPTQQSTESLTLYPTSSVSSSETEPASTPGITNHLSFVDRSTTQPSESRTKTNRTVHKKNISSTVSRTQSPPRTTAKAVPRATALRTSSTGERPTTTPVQPDSSTTTQNHEETGSANPQASASTMQNQHTNIARPN

SEQ ID NO: 136 - protein, 228 aa, human metapneumo virus
MEVKVENIRAIDMLKARVKNRVARSKCFKNASLILIGITTLSIALNIYLIINYTIQKTTSESEHHTSSPPTESNKETSTIPIDNPDINPNSQHPTQQSAESLTLYPTSSVSSSETEPASTPGITNHLSFVDRSTTQPSESRTKTNRTVHKKNISSTVSRTQSPPRTTAKAVPRATALRTSSTGERPTTTPVQPDSSTTTQNHEETGSANPQASASTMQNQHTNIARPN

SEQ ID NO: 137 - protein, 228 aa, human metapneumo virus; identical to SEQ ID NO: 135

SEQ ID NO: 138 - protein, 228 aa, human metapneumo virus
MEVKVENIRAIDMLKARVKNRVARSKCFKNASLILIGITTLSIALNIYLIINYTIQQTTSESEHHTSSPPTESNKEASTISTDNPDINPNSQHPTQQSTENPTLNPAASASPSETESASTPDTTNRLSSVDRSTVQPSENRTKTKLTVHTRNNLSTASSTQSPPRATTKAIRRATTLRMSSTGRRPTTTLVQSDSSTTTQNHEETGSANPQASASTMQNQHTNNIKPN

SEQ ID NO: 139 - protein, 228 aa, human metapneumo virus
MEVKVENIRAIDMLKARVKNRVARSKCFKNASLILIGITTLSIALNIYLIINYTIQKTTSESEHHTSSPPTESNKEASTISTDNPDINPNSQHPTQQSTENPTLNPAASASPSETESASTPDTTNRLSSVDRSTVQPSENRTKTKLTVHTRNNLSTASSTQSPPRATTKAIRRATTLRMSSTGRRPTTTLVQSDSSTTTQNHEETGSANPQASASTMQNQHTNNIKPN

SEQ ID NO: 140 - protein, 231 aa, Human metapneumo virus
  VARIANT 225: Xaa = unknown amino acid or other
MEVRVENIRAIDMFKAKIKNRIRSSRCYRNATLILIGLTALSMALNIFLIIDHATLRNMIKTENCANMPSAEPSKKTPMTSTAGPNTKPNPQQATQWTTENSTSPVATPEGHPYTGTTQTSDTTAPQQTTDKHTAPLKSTNEQITQTTTEKKTIRATTQKREKGKENTNQTTSTAATQTTNTTNQIRNASETITTSDRPRTDTTTQSSEQTTRATDPSSPPHHAXRGAKLK

SEQ ID NO: 141 - protein, 231 aa, human metapneumo virus
MEVRVENIRAIDMFKAKIKNRIRSSRCYRNATLILIGLTALSMALNIFLIIDHATLRNMIKTENCANMPSAEPSKKTPMTSTAGPSTEPNPQQATQWTTENSTSPAATLESHPYTGTTQTPDITAPQQTTDKHTALPKSTNEQITQTTTEKKTTRATTQKREKEKENTNQTTSTAATQTTNTTNQTRNASETITTSDRPRIDTTTQSSDQTTRATDPSSPPHHAQSGAKPK

SEQ ID NO: 142 - protein, 231 aa, human metapneumo virus
MEVRVENIRAIDMFKAKIKNRIRSSRCYRNATLILIGLTALSMALNIFLIIDHATLRNMIKTENCANMPPAEPSKKTPMTSTAGPNTKPNPQQATQWTTENSTFPAATSEGHLHTGTTQTPDTTAPQQTTDKHTALPKSTNEQITQTTTEKKTTRATTQRREKGKENTNQTTSTAATQTTNTTNQIRNASETITTSDRPRTDSTTQSSEQTTRATDPSSPPHHAQGSAKPK

SEQ ID NO: 143 - protein, 231 aa, human metapneumo virus
MEVRVENIRAIDMFKAKIKNRIRSSRCYRNATLILIGLTALSMALNIFLIIDHATLRNMIKTENCANMPPAEPSRKTPMTSTAGPNTKPNPQQATQWTTENSTSPAATPEGHLHTGTTQTPDTTAPQQTTDKHTALPKSTNEQITQATTEKKTTRETTQRREKGKENTNQTTSTAATQTTNTTNQIRNASETITTSDRPRTDSTTQSSEQTTQATDPSSPAHHAQGSAKPK

SEQ ID NO: 144 - protein, 231 aa, human metapneumo virus
MEVRVENIRAIDMFKAKIKNRIRSSRCYRNATLILIGLTALSMALNIFLIIDHATLRNMIKTENCANMPPAEPSKKTPMTSTAGLNTKPNPQQATQWTTENSTSPAATPEGHLHTGTTQTPDTTAPQQTTDKHTALPKSTNEQITQTTTEKKTTRATTQRREKGKENTNQTTSTAATQTTNTTNQIRNASETITTSDRPRTDSTTQSSEQTTRATDPSSPPHHAQGSAKPK

SEQ ID NO: 145 - protein, 231 aa, human metapneumo virus
MEVRVENIRAIDMFKAKIKNRIRSSRCYRNATLILIGLTALSMALNIFLIIDHATLRNMIKTENCANMPPAEPSKKTPMTSTAGPNTKPNPQQATQWTTENSTSPAATPEGHLHTGTTQTPDTTAPQQTTDKHTALPKSTNEQITQTTTEKKTTRATTQRREKGKENTNQTTSTAATQTTNTTNQIRNAIETITTSDRPRTDSTTQSSEQTTRATDPSSHPHHAQGSAKPK

SEQ ID NO: 146 - protein, 236 aa, human metapneumo virus
MEVRVENIRAIDMFKAKMKNRIRSSKCYRNATLILIGLTALSMALNIFLIIDYAMLKNMTKVEHCVNMPPVEPSKKTPMTSAVDLNTKPNPQQATQLAAEDSTSLAATSEDHLHTGTTPTPDATVSQQTTDEYTTLLRSTNRQTTQTTTEKKPTGATTKKETTTRTTSTAATQTLNTTNQTSYVREATTTSARSRNSATTQSSDQTTQAADPSSQPHHTQKSTTTTYNTDTSSPSS

SEQ ID NO: 147 - protein, 236 aa, Human metapneumo virus
  VARIANT 220, 227: Xaa = unknown amino acid or other
MEVRVENIRTIDMFKAKMKNRIRSSKCYRNATLILIGLTALSMALNIFLIIDYATFKNMTKVEHCANMPPVEPSKKTPMTSTVDSSTGPNPQQTTQWTTEDSTSLAATSEDHLHTGTTPTLDATVSQQTPDKHTTPLRSTNGQTTQTTTEKKPTRAIAKKETTNQTTSTAATQTFNTTNQTRNGRETTITSARSRNDATTQSSEQTNQTTDPSSQPHHAXISTITIXTQHRHIFSK

SEQ ID NO: 148 - protein, 236 aa, Human metapneumo virus
  VARIANT 208: Xaa = unknown amino acid or other
MEVRVENIRAIDMFKAKMKNRIRSSKCYRNATLILIGLTALSMALNIFLIIDYAMLKNMTKVEHCVNMPPVEPSKKTPMTSAVDLNTKLNPQQATQLTTEDSTSLAATSEDHLLTGTTPTPDATVSQQTTDEHTTLLRSTNRQTTQTTTEKKPTGATTKKETTTRTTSTAATQTLNTTNQTSNGREATTTSTRSRNGATTQNSDQTTXTADPSSQPHHTQKSTTTTYNTDTSSPSS

SEQ ID NO: 149 - protein, 236 aa, human metapneumo virus
MEVRVENIRAIDMFKAKMKNRIRSSKCYRNATLILIGLTALSMALNIFLIIDYATLKNMTKVEHCVNMPPVEPSKKTPMTSAVDLNTKLNPQQATQLTTEDSTSLAATSEGHPHTGTTPTPDATVSQQTTDEHTTLLRSTNRQTTQTATEKKPTGATTKKETTTRTTSTAATQTPNTTNQTSNGREATTTSARSRNGATTQNSDQITQAADSSSQPHHTQKSTTTAYNTDTSFPSS

SEQ ID NO: 150 - protein, 236 aa, human metapneumo virus
MEVRVENIRAIDMFKAKMKNRIRSSKCYRNATLILIGLTALSMALNIFLIIDYATLKNMTKVEHCVNMPPVEPSKKTPMTSAVDSNTKPNPQQATQLTTEDSTSLAATLEDHPHTGTTPTPDATVSQQTTDEHTTLLRSTNRQTTQTTAEKKPTRATTKKETTTRTTSTAATQTLNTTNQTSNGREATTTSARSRNNATTQSSDQTTQAAEPSSQSQHTQKSTTTTYNTDTSSLSS

SEQ ID NO: 151 - protein, 236 aa, human metapneumo virus
MEVRVENIRAIDMFKAKMKNRIRSSKCYRNATLILIGLSALSMALNIFLIIDYAKSKNMTRVEHCVNMPPVEPSKKTPMTSAVDLNTKPNPQRATQLTTEDSTSLAATLEGHLHTGTTPTPDVTVSQQTTDEHTTLLRSTNRQTTQTAAEKKPTRVTTNKETITRTTSTAATQTLNTTNQTNNGREATTTSARSRNNATTQSSDQTTQAADPSSQSQHTQKSITTTYNTDTSSPSS

SEQ ID NO: 152 - protein, 236 aa, human metapneumo virus
MEVRVENIRAIDMFKAKMKNRIRSSKCYRNATLILIGLSALSMALNIFLIIDYAKSKTMTRVEHCVNMPPVEPSKKTPMTSAVDLNTKPNPQQATQLTTEDSTSPAATLEGHLHTGTTPTPDATVSQQTTDEHTTLLRSTNRQTTQTTAEKKPTRATTKKETITRTTSTAATQTLNTTNQTSNGREATTTSARSRNNATTQSSDQTTQAADPSSQSQHTKKSTTTTYNTDTSSPSS

SEQ ID NO: 153 - protein, 236 aa, human metapneumo virus
MEVRVENIRAIDMFKAKMKNRIRSSKCYRNATLILIGLTALSMALNIFLIIDYATLKNMTKVEHCVNMPPVEPSKKTPMTSAVDLNTKPNPQQATQLTTEDSTSLAATLEDHPHTGTTPTPDATVSQQTTDEHTTLLRSTNRQTTQTTAEKKPTRATTKKETTTRTTSTAATQTLNTTNQTSNGREATTTSARSRNNATTQSSDQTTQAAEPNSQSQHTQKSTTTTYNTDTSSLSS

SEQ ID NO: 154 - DNA, 449 bp, human metapneumo virus
ataggagtttacggaagctccgtaatttacatggtgcaactgccaatctttggggttatagacacgccttgctggatagtaaaagcagccccttcttgttcaggaaaaaagggaaactatgcttgcctcttaagagaagaccaaggatggtattgtcaaaatgcagggtcaactgtttactacccaaatgaaaaagactgtgaaacaagaggagaccatgtcttttgcgacacagcagcaggaatcaatgttgctgagcagtcaaaggagtgcaacataaacatatctactactaattacccatgcaaagttagcacaggaagacatcctatcagtatggttgcactatctcctcttggggctttggttgcttgctacaagggagtgagctgttccattggcagcaacagagtagggatcatcaagcaactgaacaaaggctgctctta

SEQ ID NO: 155 - DNA, 449 bp, human metapneumo virus
ataggagtttacggaagctccgtaatttacatggtgcaactgccaatctttggggttatagacacgccttgctggatagtaaaagcagccccttcttgctcagaaaaaaagggaaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 156 - DNA, 449 bp, human metapneumo virus
ataggagtttacggaagctccgtaatttacatggtgcaactgccaatctttggggttatagacacgccttgctggatagtaaaagcagccccttcttgctcagaaaaaaagggaaactatgcttgcctcttaagagaagatcaaggatggtattgtcagaatgcagggtcaactgtttactacccaaatgaaaaagattgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 157 - DNA, 449 bp, human metapneumo virus; identical to SEQ ID NO: 155

SEQ ID NO: 158 - DNA, 449 bp, human metapneumo virus
ataggagtttacggaagctccgtaatttacatggtgcaactgccaatctttggggttatagacacgccttgctggatagtaaaagcagccccttcttgctcagaaaaaaagggaaactatgcttgcctcttaagagaagatcaaggatggtattgtcagaatgcagggtcaactgtttactacccaaatgaaaaagattgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggtagcaacagagtagggatcatcaagcaactgaacaaaggctgctctta

SEQ ID NO: 159 - DNA, 449 bp, human metapneumo virus
ataggagtttacggaagctccgtaatttacatggtgcaactgccaatctttggggttatagacacgccttgctggatagtaaaagcagccccttcttgttcagaaaaaaagggaaactatgcttgcctcttaagagaagaccaaggatggtattgtcagaatgcagggtcaactgtttactacccaaatgaaaaagactgtgaaacaagaggagaccatgtcttttgcgacacagcagcaggaatcaatgttgctgagcagtcaaaggagtgcaacataaacatatctactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 160 - DNA, 449 bp, human metapneumo virus; identical to SEQ ID NO: 159

SEQ ID NO: 161 - DNA, 449 bp, human metapneumo virus; identical to SEQ ID NO: 159

SEQ ID NO: 162 - DNA, 449 bp, human metapneumo virus
ataggagtttacggaagctccgtaatttacatggtgcaactgccaatctttggggttatagacacgccttgctggatagtaaaagcagccccttcttgctcagaaaaaaagggaaactatgcttgcctcttaagagaagatcagggatggtattgtcagaatgcagggtcaactgtttactacccaaatgaaaaagactgtgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtaggaatcatcaagcaactgaacaaaggctgctctta

SEQ ID NO: 163 - DNA, 449 bp, human metapneumo virus
ataggagtttacggaagctccgtaatttacatggtgcaactgccaatctttggagttatagacacgccttgctggatagtaaaagcagccccttcttgctcagaaaaaaagggaaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 164 - DNA, 449 bp, human metapneumo virus
ataggagtttacggaagctccgtaatttacatggtgcaactgccaatctttggggttatagacacgccttgttggatagtaaaagcagccccttcttgctcagaaaaaaaggggaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 165 - DNA, 449 bp, human metapneumo virus
ataggagtttacggaagctccgtaatttacatggtgcaactgccaatctttggagttatagacacgccttgctggatagtaaaagcggccccttcttgctcagaaaaaaagggaaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 166 - DNA, 449 bp, human metapneumo virus
ataggagtttacggaagctccgtaatttacatggtgcaactgccaatctttggggttatagacacgccttgctggatagtaaaagcagccccttcttgctcagaaaaaaagggaaactatgcttgccttttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaatatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 167 - DNA, 449 bp, human metapneumo virus
ataggagtttacggaagctccgtaatttacatggtgcaactgccaatctttggagttatagacacgccttgctggatagtaaaagcggccccttcttgctcggaaaaaaagggaaactatgcttgcctcttaagagaagatcaaagatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 168 - DNA, 449 bp, human metapneumo virus
ataggagtttatggaagctccgtaatttacatggtgcaactgccaatctttggagttatagacacgccttgctggatagtaaaagcggccccttcttgctcagaaaaaaagggaaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttctattggcagcaacagagtagggatcatcaagcaactgaacaaaggctgctctta

SEQ ID NO: 169 - DNA, 449 bp, human metapneumo virus
ataggagtttatggaagctccgtaatttacatggtgcaactgccaatctttggagttatagacacgccttgctggatagtaaaagcggccccttcttgctcagaaaaaaagggaaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 170 - DNA, 449 bp, human metapneumo virus
ataggagtttacggaagctccgtaatttacatggtgcaactgccaatctttggagttatagacacgccttgctggatagtaaaagcggccccttcttgctcagaaaaaaagggaaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccaccactaattacccatgcaaagttagcacaggaagacatcctatcagtatggttgcactgtctcctcttggggctttggttgcttgctacaagggagtgagctgttccattggcagcaacagagtagggatcatcaagcaactgaacaaaggctgctctta

SEQ ID NO: 171 - DNA, 449 bp, human metapneumo virus; identical to SEQ ID NO: 169

SEQ ID NO: 172 - DNA, 449 bp, human metapneumo virus; identical to SEQ ID NO: 169

SEQ ID NO: 173 - DNA, 449 bp, human metapneumo virus; identical to SEQ ID NO: 169

SEQ ID NO: 174 - DNA, 449 bp, human metapneumo virus; identical to SEQ ID NO: 154

SEQ ID NO: 175 - DNA, 449 bp, human metapneumo virus; identical to SEQ ID NO: 154

SEQ ID NO: 176 - DNA, 449 bp, human metapneumo virus; identical to SEQ ID NO: 170

SEQ ID NO: 177 - DNA, 449 bp, human metapneumo virus
ataggagtttacggaagctccgtaatttacatggtgcaactgccaatctttggggttatagacacgccttgctggatagtaaaagcagccccttcttgctcagaaaaaaagggaaactatgcttgcctcttaagagaagatcaaggatggtattgtcagaatgcagggtcaactgtttactacccaaatgaaaaagactgcgaaacaagaggagaccatgtcttttgcgacacagcagcaggaatcaatgttgctgagcagtcaaaggagtgcaacatcaacatatccactactaattacccatgcaaagttagcacaggaagacatcctatcagtatggttgcactgtctcctcttggggctctggttgcttgctacaagggagtgagctgctccattggcagcaacagagtagggatcatcaagcaactgaacaaaggctgctctta

SEQ ID NO: 178 - DNA, 449 bp, human metapneumo virus; identical to SEQ ID NO: 170

SEQ ID NO: 179 - DNA, 449 bp, human metapneumo virus; identical to SEQ ID NO: 170

SEQ ID NO: 180 - DNA, 449 bp, human metapneumo virus; identical to SEQ ID NO: 154

SEQ ID NO: 181 - DNA, 449 bp, human metapneumo virus; identical to SEQ ID NO: 169

SEQ ID NO: 182 - DNA, 449 bp, human metapneumo virus; identical to SEQ ID NO: 154

SEQ ID NO: 183 - DNA, 449 bp, human metapneumo virus
ataggggtctacgggagctctgtaatttacatggtgcagctgccaatctttggcgttatagacacgccttgctggatagtaaaagcagccccctcttgttccgaaaaaaagggaaactatgcttgcctcttaagagaagaccaagggtggtattgtcagaatgcagggtcaactgtttactacccaaatgagaaagactgtgaaacaagaggagaccatgtcttttgcgacacagcagcaggaattaatgttgctgagcaatcaaaggagtgcaacatcaacatatccactacaaattacccatgcaaagtcagcacaggaagacatcctatcagtatggttgcactgtcccctcttggggctctggttgcttgctacaaaggagtaagctgttccattggcagcaatagagtagggattatcaagcagctgaacaaaggttgctctta

SEQ ID NO: 184 - DNA, 449 bp, human metapneumo virus
ataggggtctacgggagctccgtaatttacatggtgcagctgccaatctttggcgtcatagacacgccttgctggatagtaaaagcagccccctcttgttccgaaaaaaagggaaactatgcttgccttttaagagaagatcaagggtggtattgtcagaatgcagggtcaactgtttactacccaaatgagaaagactgtgaaacaagaggagaccatgtcttttgcgacacagcagcaggaattaatgttgctgagcaatcaaaagagtgcaacatcaacatatccactacaaattacccatgcaaagtcagcacaggaagacatcctatcagtatggttgcactgtcccctcttggggctctagttgcttgctacaaaggagtaagctgttccattggcagcaatagagtagggatcatcaagcagctgaacaaaggttgctccta

SEQ ID NO: 185 - DNA, 449 bp, human metapneumo virus
ataggggtctacgggagctccgtaatttacatggtgcagctgccaatctttggcgtcatagacacgccttgctggatagtaaaagcagccccctcttgttccgaaaaaaagggaaactatgcttgccttttaagagaagatcaagggtggtattgtcagaatgcagggtcaactgtttactacccaaatgagaaagactgtgaaacaagaggagaccatgtcttttgcgacacagtagcaggaattaatgttgctgagcaatcaaaagagtgcaacatcaacatatccactacaaattacccatgcaaagtcagcacaggaagacatcctatcagtatggttgcactgtcccctcttggggctctagttgcttgctacaaaggagtaagctgttccattggcagcaatagagtagggatcatcaagcagctgaacaaaggttgctccta

SEQ ID NO: 186 - DNA, 449 bp, human metapneumo virus; identical to SEQ ID NO: 184

SEQ ID NO: 187 - DNA, 449 bp, human metapneumo virus
ataggggtctacgggagctccgtaatttacatggtgcagctgccaatctttggcgttatagacacgccctgctggatagtaaaagcagccccctcttgttccgaaaaaaagggaaactatgcttgccttctaagagaagaccaagggtggtattgtcagaatgcagggtcaactgtttactacccaaatgagaaggactgtgaaacaagaggagaccatgtcttttgcgacacagcagcaggaattaatgttgctgagcaatcaaaggagtgcaacatcaacatatccaccacaaattacccatgcaaagtcagcacaggaaggcatcctatcagtatggttgcactgtcccctcttggggctctggttgcttgttacaaaggagtaagctgttctattggcagcaatagagtagggatcatcaagcagctgaacaaaggttgctctta

SEQ ID NO: 188 - DNA, 449 bp, human metapneumo virus
ataggggtctacgggagctccgtaatttacatggtgcagctgccaatctttggcgttatagacacgccttgctggatagtaaaagcagccccctcttgttccgaaaaaaagggaaactatgcttgcctcttaagagaagaccaagggtggtattgtcagaatgcagggtcaactgtttactacccaaatgagaaagactgtgaaacaagaggagaccatgtcttttgcgacacagcagcaggaattaatgttgctgagcaatcaaaggagtgcaacatcaacatatccactacaaattacccatgcaaagtcagcacaggaagacatcctatcagtatggttgcactgtctcctcttggggctctagttgcttgctacaaaggagtaagctgttccattggcagcaacagagtagggatcatcaagcagctgaacaaaggttgctccta

SEQ ID NO: 189 - DNA, 449 bp, human metapneumo virus; identical to SEQ ID NO: 187

SEQ ID NO: 190 - DNA, 449 bp, human metapneumo virus
ataggggtctacgggagctccgtaatttacatggtgcagctgccaatctttggcgttatagacacgccttgctggatagtaaaagcagccccttcttgttccgaaaaaaagggaaactatgcttgcctcttaagagaagaccaagggtggtattgtcagaatgcagggtcaactgtttactacccaaatgagaaagactgtgaaacaagaggagaccatgtcttttgcgacacagcagcaggaattaatgttgctgagcaatcaaaggagtgcaacatcaacatatccactacaaattacccatgcaaagtcagcacaggaagacatcctatcagtatggttgcactgtctcctcttggggctctggttgcttgctacaaaggagtaagctgttccattggcagcaacagagtagggatcatcaagcagctgaacaaaggttgctccta

SEQ ID NO: 191 - DNA, 449 bp, human metapneumo virus; identical to SEQ ID NO: 190

SEQ ID NO: 192 - DNA, 449 bp, human metapneumo virus
ataggggtctacgggagctccgtaatttacatggtgcagctgccaatctttggcgttatagacacgccttgctggatagtaaaagcagccccttcttgttccgaaaaaaagggaaactatgcttgcctcttaagagaagaccaaggatggtattgtcagaatgcagggtcaactgtttactacccaaatgagaaagactgtgaaacaagaggagaccatgtcttttgcgacacagcagcaggaattaatgttgctgagcaatcaaaggagtgcaacatcaacatatccaccacaaattacccatgcaaagtcagcacaggaaggcatcctatcagtatggttgcactgtcccctctcggggctctggttgcctgttacaaaggagtaagttgttccattggcagcaatagagtagggatcatcaagcagctgaacaaaggttgctctta

SEQ ID NO: 193 - DNA, 449 bp, human metapneumo virus
ataggggtctacgggagctccgtaatttacatggtgcagctgccaatctttggcgttatagacacgccttgctggatagtaaaagcagccccttcttgttccgaaaaaaagggaaactatgcttgcctcttaagagaagaccaagggtggtattgtcagaatgcagggtcaactgtttactacccaaatgagaaagactgtgaaacaagaggagaccatgtcttttgcgacacagcagcaggaattaatgttgctgagcaatcaaaggagtgcaacatcaacatatccactacaaattacccatgcaaagtcagcacaggaagacatcctatcagtatggttgcactgtctcctcttggggctctggttgcttgctacaaaggagtaagctgttccattggcagcaacagagtagggatcataaagcagctgaacaaaggttgctccta

SEQ ID NO: 194 - DNA, 449 bp, human metapneumo virus; identical to SEQ ID NO: 192

SEQ ID NO: 195 - DNA, 449 bp, human metapneumo virus
ataggggtctacgggagctccgtaatttacatggtgcagctgccaatctttggcgttatagacacaccttgctggatagtaaaagcagccccttcttgttccgaaaaaaagggaaattatgcttgcctcttaagagaagaccaagggtggtattgtcagaatgcagggtcaactgtttactacccaaatgagaaagactgtgaaacaagaggagaccatgtcttttgcgacacagcagcaggaattaatgttgctgagcaatcaaaggaatgcaacatcaacatatccactacaaattacccatgcaaagtcagcacaggaagacatcctatcagtatggttgcactgtctcctcttggggctctggttgcttgctacaaaggagtaagctgttccattggcagcaacagagtagggatcatcaagcagctgaacaaaggttgctccta

SEQ ID NO: 196 - DNA, 449 bp, human metapneumo virus; identical to SEQ ID NO: 192

SEQ ID NO: 197 - DNA, 449 bp, human metapneumo virus; identical to SEQ ID NO: 193

SEQ ID NO: 198 - DNA, 449 bp, human metapneumo virus
ataggggtctacggaagctccgtgatttacatggttcaattgccgatctttggtgtcatagatacaccttgttggataatcaaggcagctccctcttgctcagaaaaaaacgggaattatgcttgcctcctaagagaggatcaagggtggtattgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacctaaaggctgctcata

SEQ ID NO: 199 - DNA, 449 bp, human metapneumo virus
ataggggtctacggaagctctgtgatttacatggttcaattgccgatctttggtgtcatagatacaccttgttggatcatcaaggcagctccctcttgctcagaaaaaaacgggaattatgcttgcctcctaagagaggatcaagggtggtattgtaaaaatgcaggatctactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaattgggttggaatcatcaaacaattacccaaaggctgctcata

SEQ ID NO: 200 - DNA, 449 bp, human metapneumo virus
ataggggtctacggaagctctgtgatttacatggttcaattgccgatctttggtgtcatagatacaccttgttggatcatcaaggcagctccctcttgctcagaaaaaaacgggaattatgcttgcctcctaagagaggatcaagggtggtattgtaaaaatgcaggatctactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacccaaaggctgctcata

SEQ ID NO: 201 - DNA, 449 bp, human metapneumo virus; identical to SEQ ID NO: 200

SEQ ID NO: 202 - DNA, 449 bp, human metapneumo virus
ataggggtctacggaagctctgtgatttacatggttcaattgccgatctttggtgtcatagatacaccttgttggataatcaaggcagctccctcttgctcagaaaaaaacgggaattatgcttgcctcctaagagaggatcaagggtggtattgcaaaaatgcaggatccactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacctaaaggctgctcata

SEQ ID NO: 203 - DNA, 449 bp, human metapneumo virus; identical to SEQ ID NO: 198

SEQ ID NO: 204 - DNA, 449 bp, human metapneumo virus
ataggggtctacggaagctctgtaatttacatggttcaattgccgatctttggtgtcatagatacaccttgttggataatcaaggcagctccctcttgctcagaaaaaaacgggaattatgcttgcctcctaagagaggatcaagggtggtattgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacctaaaggctgctcata

SEQ ID NO: 205 - DNA, 449 bp, human metapneumo virus
ataggggtctacggaagctccgtgatttacatggttcaattgccgatctttggtgtcatagatacaccttgttggataatcaaggcagctccctcttgctcagaaaaaaacgggaattatgcttgcctcctaagagaggatcaagggtggtattgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacactctataagcatggttgcactatcacctctcggtgctttggtggcttgctataaaggggtaagctgctcgattggcagcaatcgggttggaatcatcaaacaattacctaaaggctgctcata

SEQ ID NO: 206 - DNA, 449 bp, human metapneumo virus; identical to SEQ ID NO: 198

SEQ ID NO: 207 - DNA, 449 bp, human metapneumo virus
ataggggtctacggaagctctgtgatttacatggttcaattgccgatctttggtgtcatagatacaccttgttggataatcaaggcagctccctcttgctcagaaaaaaacgggaattatgcttgcctcctaagagaggatcaagggtggtattgtaaaaatgcaggatccactgtttactacccaaatgaaaaagactgtgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacctaaaggctgctcata

SEQ ID NO: 208 - DNA, 449 bp, human metapneumo virus
ataggggtctacggaagctccgtgatttacatggttcaattgccgatctttggtgtcatagatacaccttgttggataatcaaggcagctccctcttgctcagaaaaaaacgggaattatgcttgcctcctaagagaggatcaagggtggtactgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacctaaaggctgctcata

SEQ ID NO: 209 - DNA, 449 bp, human metapneumo virus
ataggggtctacggaagctctgtgatttacatggttcaattgccgatctttggggtcatagatacaccttgttggataatcaaggcagctccctcttgctcagaaaaaaacgggaattatgcttgcctcctaagagaggatcaagggtggtattgtaaaaatgcaggatccactgtttactacccaaatgaaaaagactgcgaaacaagaggtgatcatgttttttgtgatacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacccaaaggctgctcata

SEQ ID NO: 210 - DNA, 449 bp, human metapneumo virus
ataggggtctacggaagctctgtgatttacatggttcaattgccgatctttggtgtcatagatacaccttgttggataatcaaggcagccccctcttgctcagagaaaaacgggaattatgcttgcctcctaagagaggatcaagggtggtattgtaaaaatgcaggatccactgtttactacccaaatgaaaaagactgcgaaacaagaggtgatcatgtgttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaattatcaaacaattacctaaaggctgctcata

SEQ ID NO: 211 - DNA, 449 bp, human metapneumo virus
ataggggtctacggaagctctgtgatttacatggttcaattgccgatctttggtgtcatagatacaccttgttggataatcaaggcagctccctcttgctcagagaaaaacgggaattatgcttgcctcctaagagaggatcaagggtggtattgtaaaaatgcaggatccactgtttactacccaaatgaaaaagactgcgaaacaagaggtgatcatgtgttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacctaaaggctgctcata

SEQ ID NO: 212 - DNA, 449 bp, human metapneumo virus; identical to SEQ ID NO: 207

SEQ ID NO: 213 - DNA, 449 bp, human metapneumo virus; identical to SEQ ID NO: 198

SEQ ID NO: 214 - DNA, 449 bp, human metapneumo virus; identical to SEQ ID NO: 211

SEQ ID NO: 215 - DNA, 449 bp, human metapneumo virus
ataggggtctacggaagctctgtgatttacatggttcaattgccgatctttggtgtcatagatacaccttgttggataatcaaggcagctccctcttgctcagaaaaaaacgggaattatgcttgcctcctaagagaggatcaagggtggtattgtaaaaatgcaggatccactgtttactacccaaatgaaaaagactgcgaaacaagaggtgatcatgttttttgtgatacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaatcgggttggaatcatcaaacaattacccaaaggctgctcata

SEQ ID NO: 216 - DNA, 449 bp, human metapneumo virus; identical to SEQ ID NO: 208

SEQ ID NO: 217 - DNA, 449 bp, human metapneumo virus
ataggggtctacggaagctctgtgatttacatggtccagctgccgatctttggtgtcatagatacaccttgttggataatcaaggcagctccctcttgttcagaaaaagatggaaattatgcttgcctcctaagagaggatcaagggtggtattgcaaaaatgcaggatccactgtttactacccaaatgaaaaagactgcgaaacaagaggtgatcatgttttttgtgacacagcagcagggatcaatgttgctgagcaatcaagagaatgcaacatcaacatatctaccaccaactacccatgcaaagtcagcacaggaagacaccctatcagcatggttgcactatcacctctcggtgctttggtagcttgctacaagggggttagctgctcgattggcagtaatcgggttggaataatcaaacaactacctaaaggctgctcata

SEQ ID NO: 218 - DNA, 449 bp, human metapneumo virus
ataggggtctacggaagctctgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctaccaccaactacccatgcaaagtcagcacaggaagacaccccatcagcatggttgcactatcacctctcggtgctttggtagcttgctacaaaggggttagctgctcgattggcagtaatcgggttggaataatcaaacaactacctaaaggctgctcata

SEQ ID NO: 219 - DNA, 449 bp, human metapneumo virus
ataggggtctacggaagctctgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctaccaccaactacccatgcaaagtcagcacaggaagacaccctatcagcatggttgcactatcacctctcggtgctttggtagcttgctacaaaggggttagctgctcgattggcagtaatcgggttggaataatcaaacaactacctaaaggctgctcata

SEQ ID NO: 220 - DNA, 449 bp, human metapneumo virus
ataggggtctacggaagctccgtgatttacatggtccagctgccgatctttggtgtcatagatacaccttgttggataatcaaggcagctccctcttgttcagaaaaagatggaaattatgcttgcctcctaagagaggaccaagggtggtattgtaaaaatgcgggatccactgtttactacccaaatgaaaaagactgcgaaacaagaggtgatcatgttttttgtgacacagcagcagggatcaatgttgctgagcaatcaagagaatgcaacatcaacatatctacaaccaactacccatgcaaagtcagcacaggaagacaccctatcagcatggttgcactatcacctctcggtgctttggtagcttgctacaaaggggttagctgttcgattggcagtaatcgggttggaataatcaaacaactacctaaaggctgctcata

SEQ ID NO: 221 - DNA, 449 bp, human metapneumo virus
ataggggtctacggaagctccgtgatttacatggtccagctaccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagctgcagggatcaatgttgctgagcaatcaagagaatgcaacatcaacatatccacaaccaactacccatgcaaagtcagcacaggaagacaccctatcagcatggttgcactgtcacctctcggcgctttggtagcttgctacaaaggggttagctgttcgattggcagtaatcgggttggaataatcaaacaactacctaaaggctgctcata

SEQ ID NO: 222 - DNA, 449 bp, human metapneumo virus
ataggggtctacggaagctccgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctatcagcatggttgcactatcacctctcggtgctttggtagcttgctacaaaggggttagctgttcgattggcagtaatcgggttggaataatcaaacaactacctaaaggctgctcata

SEQ ID NO: 223 - DNA, 449 bp, human metapneumo virus
ataggggtctacggaagctccgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgtgaaacaagaggtgatcatgttttttgtgacacagcagcagggatcaatgttgctgagcaatcaagagaatgcaacatcaacatatctacaaccaactacccatgcaaagtcagcacaggaagacaccctatcagcatggttgcactatcacctctcggtgctttggtagcttgctacaaaggggttagctgttcgattggcagtaatcgggttggaataatcaaacaactacctaaaggctgctcata

SEQ ID NO: 224 - DNA, 449 bp, human metapneumo virus; identical to SEQ ID NO: 220

SEQ ID NO: 225 - DNA, 449 bp, human metapneumo virus
ataggggtctacggaagctccgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagcagcagggatcaatgttgctgagcaatcaagagaatgcaacatcaacatatctacaaccaactacccatgcaaagtcagcacaggaagacaccctatcagcatggttgcactatcacctctcggtgctttggtagcttgctacaaaggggttagctgttcgattggcagtaatcgggttggaataatcaaacaactacctaaaggctgctcata

SEQ ID NO: 226 - DNA, 449 bp, human metapneumo virus; identical to SEQ ID NO: 223

SEQ ID NO: 227 - DNA, 449 bp, human metapneumo virus
ataggggtctacggaagctccgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagctgcagggatcaatgttgctgagcaatcaagagaatgcaacatcaacatatctacaaccaactacccatgcaaagtcagcacaggaagacaccctatcagcatggttgcactatcacctctcggtgctttggtagcttgctacaaaggggttagctgttcaattggcagtaatcgggttggaataatcaaacaactacctaaaggctgctcata

SEQ ID NO: 228 - DNA, 449 bp, human metapneumo virus; identical to SEQ ID NO: 227

SEQ ID NO: 229 - DNA, 449 bp, human metapneumo virus
ataggggtctacggaagctccgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagctgcagggatcaatgttgctgagcaatcaagagaatgcaacatcaacatatctacaaccaactacccatgcaaagtcagcacaggaagacaccctatcagcatggttgcactatcacctctcggtgctttggtagcttgctacaagggggttagctgttcgattggcagtaatcgggttggaataatcaaacaactacctaaaggctgctcata

SEQ ID NO: 230 - DNA, 449 bp, human metapneumo virus
ataggggtctacggaagctctgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagctgcagggatcaatgttgctgagcaatcaagagaatgcaacatcaacatatccacaaccaactacccatgcaaagtcagcacaggaagacaccctatcagcatggttgcactgtcacctctcggcgctttggtagcttgctacaaaggggttagctgttcgattggcagtaatcgggttggaataatcaaacaactacctaaaggctgctcata

SEQ ID NO: 231 - DNA, 449 bp, human metapneumo virus
ataggggtctacggaagctctgtgatttacatggtccagctgccgatctttggtgtcatagatacaccttgttggataatcaaggcagctccctcttgttcagaaaaagatggaaattatgcttgcctcctaagagaggatcaagggtggtattgtaaaaatgcaggatccactgtttactacccaaatgaaaaagactgcgaaacaagaggtgatcatgttttttgtgacacagcagcagggatcaacgttgctgagcaatcaagagaatgcaacatcaacatatctaccaccaactatccgtgcaaagtcagcacaggaagacaccctatcagcatggttgcactatcacctctcggtgctttggtagcttgctacaaaggggttagctgctcgattggcagtaatcgggttggaataatcaaacaactacctaaaggctgctcata

SEQ ID NO: 232 - DNA, 449 bp, human metapneumo virus; identical to SEQ ID NO: 227

SEQ ID NO: 233 - DNA, 449 bp, human metapneumo virus; identical to SEQ ID NO: 225

SEQ ID NO: 234 - protein, 149 aa, human metapneumo virus
IGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCS

SEQ ID NO: 235 - protein, 149 aa, human metapneumo virus
IGVYGSSVIYMVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCS

SEQ ID NO: 236 - protein, 149 aa, human metapneumo virus; identical to SEQ ID NO: 235

SEQ ID NO: 237 - protein, 149 aa, human metapneumo virus; identical to SEQ ID NO: 235

SEQ ID NO: 238 - protein, 149 aa, human metapneumo virus; identical to SEQ ID NO: 235

SEQ ID NO: 239 - protein, 149 aa, human metapneumo virus; identical to SEQ ID NO: 235

SEQ ID NO: 240 - protein, 149 aa, human metapneumo virus; identical to SEQ ID NO: 235

SEQ ID NO: 241 - protein, 149 aa, human metapneumo virus; identical to SEQ ID NO: 235

SEQ ID NO: 242 - protein, 149 aa, human metapneumo virus; identical to SEQ ID NO: 235

SEQ ID NO: 243 - protein, 149 aa, human metapneumo virus; identical to SEQ ID NO: 235

SEQ ID NO: 244 - protein, 149 aa, human metapneumo virus; identical to SEQ ID NO: 235

SEQ ID NO: 245 - protein, 149 aa, human metapneumo virus; identical to SEQ ID NO: 235

SEQ ID NO: 246 - protein, 149 aa, human metapneumo virus; identical to SEQ ID NO: 235

SEQ ID NO: 247 - protein, 149 aa, human metapneumo virus
IGVYGSSVIYMVQLPIFGVIDTPCWIVKAAPSCSEKKGNYACLLREDQRWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCS

SEQ ID NO: 248 - protein, 149 aa, human metapneumo virus; identical to SEQ ID NO: 235

SEQ ID NO: 249 - protein, 149 aa, human metapneumo virus; identical to SEQ ID NO: 235

SEQ ID NO: 250 - protein, 149 aa, human metapneumo virus; identical to SEQ ID NO: 235

SEQ ID NO: 251 - protein, 149 aa, human metapneumo virus; identical to SEQ ID NO: 235

SEQ ID NO: 252 - protein, 149 aa, human metapneumo virus; identical to SEQ ID NO: 235

SEQ ID NO: 253 - protein, 149 aa, human metapneumo virus; identical to SEQ ID NO: 235

SEQ ID NO: 254 - protein, 149 aa, human metapneumo virus; identical to SEQ ID NO: 234

SEQ ID NO: 255 - protein, 149 aa, human metapneumo virus; identical to SEQ ID NO: 234

SEQ ID NO: 256 - protein, 149 aa, human metapneumo virus; identical to SEQ ID NO: 235

SEQ ID NO: 257 - protein, 149 aa, human metapneumo virus; identical to SEQ ID NO: 235

SEQ ID NO: 258 - protein, 149 aa, human metapneumo virus; identical to SEQ ID NO: 235

SEQ ID NO: 259 - protein, 149 aa, human metapneumo virus; identical to SEQ ID NO: 235

SEQ ID NO: 260 - protein, 149 aa, human metapneumo virus; identical to SEQ ID NO: 234

SEQ ID NO: 261 - protein, 149 aa, human metapneumo virus; identical to SEQ ID NO: 235

SEQ ID NO: 262 - protein, 149 aa, human metapneumo virus; identical to SEQ ID NO: 234

SEQ ID NO: 263 - protein, 149 aa, human metapneumo virus; identical to SEQ ID NO: 235

SEQ ID NO: 264 - protein, 149 aa, human metapneumo virus; identical to SEQ ID NO: 235

SEQ ID NO: 265 - protein, 149 aa, human metapneumo virus
IGVYGSSVIYMVQLPIFGVIDTPCWIVKAAPSCSEKKGNYACLLREDQGWYCQNAGSTVYYPNEKDCETRGDHVFCDTVAGINVAEQSKECNINISTTNYPCKVSTGRHPISMVALSPLGALVACYKGVSCSIGSNRVGIIKQLNKGCS

SEQ ID NO: 266 - protein, 149 aa, human metapneumo virus; identical to SEQ ID NO: 235

SEQ ID NO: 267 - protein, 149 aa, human metapneumo virus; identical to SEQ ID NO: 235

SEQ ID NO: 268 - protein, 149 aa, human metapneumo virus; identical to SEQ ID NO: 235

SEQ ID NO: 269 - protein, 149 aa, human metapneumo virus; identical to SEQ ID NO: 235

SEQ ID NO: 270 - protein, 149 aa, human metapneumo virus; identical to SEQ ID NO: 235

SEQ ID NO: 271 - protein, 149 aa, human metapneumo virus; identical to SEQ ID NO: 235

SEQ ID NO: 272 - protein, 149 aa, human metapneumo virus; identical to SEQ ID NO: 235

SEQ ID NO: 273 - protein, 149 aa, human metapneumo virus; identical to SEQ ID NO: 235

SEQ ID NO: 274 - protein, 149 aa, human metapneumo virus; identical to SEQ ID NO: 235

SEQ ID NO: 275 - protein, 149 aa, human metapneumo virus; identical to SEQ ID NO: 235

SEQ ID NO: 276 - protein, 149 aa, human metapneumo virus; identical to SEQ ID NO: 235

SEQ ID NO: 277 - protein, 149 aa, human metapneumo virus; identical to SEQ ID NO: 235

SEQ ID NO: 278 - protein, 149 aa, human metapneumo virus
IGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNRVGIIKQLPKGCS

SEQ ID NO: 279 - protein, 149 aa, human metapneumo virus
IGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCS

SEQ ID NO: 280 - protein, 149 aa, human metapneumo virus; identical to SEQ ID NO: 278

SEQ ID NO: 281 - protein, 149 aa, human metapneumo virus; identical to SEQ ID NO: 278

SEQ ID NO: 282 - protein, 149 aa, human metapneumo virus; identical to SEQ ID NO: 278

SEQ ID NO: 283 - protein, 149 aa, human metapneumo virus; identical to SEQ ID NO: 278

SEQ ID NO: 284 - protein, 149 aa, human metapneumo virus; identical to SEQ ID NO: 278

SEQ ID NO: 285 - protein, 149 aa, human metapneumo virus
IGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHSISMVALSPLGALVACYKGVSCSIGSNRVGIIKQLPKGCS

SEQ ID NO: 286 - protein, 149 aa, human metapneumo virus; identical to SEQ ID NO: 278

SEQ ID NO: 287 - protein, 149 aa, human metapneumo virus; identical to SEQ ID NO: 278

SEQ ID NO: 288 - protein, 149 aa, human metapneumo virus; identical to SEQ ID NO: 278

SEQ ID NO: 289 - protein, 149 aa, human metapneumo virus; identical to SEQ ID NO: 278

SEQ ID NO: 290 - protein, 149 aa, human metapneumo virus; identical to SEQ ID NO: 278

SEQ ID NO: 291 - protein, 149 aa, human metapneumo virus; identical to SEQ ID NO: 278

SEQ ID NO: 292 - protein, 149 aa, human metapneumo virus; identical to SEQ ID NO: 278

SEQ ID NO: 293 - protein, 149 aa, human metapneumo virus; identical to SEQ ID NO: 278

SEQ ID NO: 294 - protein, 149 aa, human metapneumo virus; identical to SEQ ID NO: 278

SEQ ID NO: 295 - protein, 149 aa, human metapneumo virus; identical to SEQ ID NO: 278

SEQ ID NO: 296 - protein, 149 aa, human metapneumo virus; identical to SEQ ID NO: 278

SEQ ID NO: 297 - protein, 149 aa, human metapneumo virus
IGVYGSSVIYMVQLPIFGVIDTPCWIIKAAPSCSEKDGNYACLLREDQGWYCKNAGSTVYYPNEKDCETRGDHVFCDTAAGINVAEQSRECNINISTTNYPCKVSTGRHPISMVALSPLGALVACYKGVSCSIGSNRVGIIKQLPKGCS

SEQ ID NO: 298 - protein, 149 aa, human metapneumo virus; identical to SEQ ID NO: 297

SEQ ID NO: 299 - protein, 149 aa, human metapneumo virus; identical to SEQ ID NO: 297

SEQ ID NO: 300 - protein, 149 aa, human metapneumo virus; identical to SEQ ID NO: 297

SEQ ID NO: 301 - protein, 149 aa, human metapneumo virus; identical to SEQ ID NO: 297

SEQ ID NO: 302 - protein, 149 aa, human metapneumo virus; identical to SEQ ID NO: 297

SEQ ID NO: 303 - protein, 149 aa, human metapneumo virus; identical to SEQ ID NO: 297

SEQ ID NO: 304 - protein, 149 aa, human metapneumo virus; identical to SEQ ID NO: 297

SEQ ID NO: 305 - protein, 149 aa, human metapneumo virus; identical to SEQ ID NO: 297

SEQ ID NO: 306 - protein, 149 aa, human metapneumo virus; identical to SEQ ID NO: 297

SEQ ID NO: 307 - protein, 149 aa, human metapneumo virus; identical to SEQ ID NO: 297

SEQ ID NO: 308 - protein, 149 aa, human metapneumo virus; identical to SEQ ID NO: 297

SEQ ID NO: 309 - protein, 149 aa, human metapneumo virus; identical to SEQ ID NO: 297

SEQ ID NO: 310 - protein, 149 aa, human metapneumo virus; identical to SEQ ID NO: 297

SEQ ID NO: 311 - protein, 149 aa, human metapneumo virus; identical to SEQ ID NO: 297

SEQ ID NO: 312 - protein, 149 aa, human metapneumo virus; identical to SEQ ID NO: 297

SEQ ID NO: 313 - protein, 149 aa, human metapneumo virus; identical to SEQ ID NO: 297

SEQ ID NO: 314 - protein, 539 aa, human metapneumo virus
MSWKVVIIFSLLITPQHGLKESYLEESCSTITEGYLSVLRTGWYTNVFTLEVGDVENLTCADGPSLIKTELDLTKSALRELRTVSADQLAREEQIENPRQSRFVLGAIALGVATAAAVTAGVAIAKTIRLESEVTAIKNALKKTNEAVSTLGNGVRVLATAVRELKDFVSKNLTRAINKNKCDIADLKMAVSFSQFNRRFLNVVRQFSDNAGITPAISLDLMTDAELARAVSNMPTSAGQIKLMLENRAMVRRKGFGILIGVYGSSVIYMVQLPIFGVIDTPCWIVKAAPSCSGKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPVKFPEDQFNVALDQVFESIENSQALVDQSNRILSSAEKGNTGFIIVIILIAVLGSTMILVSVFIIIKKTKKPTGAPPELSGVTNNGFIPHN

SEQ ID NO: 315 - protein, 539 aa, human metapneumo virus
MSWKVVIIFSLLITPQHGLKESYLEESCSTITEGYLSVLRTGWYTNVFTLEVGDVENLTCSDGPSLIKTELDLTKSALRELKTVSADQLAREEQIENPRQSRFVLGAIALGVATAAAVTAGVAIAKTIRLESEVTAIKNALKTTNEAVSTLGNGVRVLATAVRELKDFVSKNLTRAINKNKCDIDDLKMAVSFSQFNRRFLNVVRQFSDNAGITPAISLDLMTDAELARAVSNMPTSAGQIKLMLENRAMVRRKGFGILIGVYGSSVIYTVQLPIFGVIDTPCWIVKAAPSCSEKKGNYACLLREDQGWYCQNAGSTVYYPNEKDCETRGDHVFCDTAAGINVAEQSKECNINISTTNYPCKVSTGRHPISMVALSPLGALVACYKGVSCSIGSNRVGIIKQLNKGCSYITNQDADTVTIDNTVYQLSKVEGEQHVIKGRPVSSSFDPIKFPEDQFNVALDQVFENIENSQALVDQSNRILSSAEKGNTGFIIVIILIAVLGSSMILVSIFIIIKKTKKPTGAPPELSGVTNNGFIPHS

SEQ ID NO: 316 - protein, 539 aa, human metapneumo virus
MSWKVMIIISLLITPQHGLKESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKQTNEAVSTLGNGVRVLATAVRELKEFVSKNLTSAINRNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKNGNYACLLREDQGWYCKNAGSTVYYPNEKDCETRGDHVFCDTAAGINVAEQSRECNINISTTNYPCKVSTGRHPISMVALSPLGALVACYKGVSCSIGSNWVGIIKQLPKGCSYITNQDADTVTIDNTVYQLSKVEGEQHVIKGRPVSSSFDPIKFPEDQFNVALDQVFESIENSQALVDQSNKILNSAEKGNTGFIIVVILVAVLGLTMISVSIIIIIKKTRKPTGAPPELNGVTNGGFIPHS

SEQ ID NO: 317 - protein, 539 aa, human metapneumo virus
MSWKVMIIISLLITPQHGLKESYLEESCSTITEGYLSVLRTGWYTNVFTLEVGDVENLTCTDGPSLIKTELDLTKSALRELKTVSADQLAREEQIENPRQSRFVLGAIALGVATAAAVTAGIAIAKTIRLESEVNAIKGALKTTNEAVSTLGNGVRVLATAVRELKEFVSKNLTSAINKNKCDIADLKMAVSFSQFNRRFLNVVRQFSDNAGITPAISLDLMTDAELARAVSYMPTSAGQIKLMLENRAMVRRKGFGILIGVYGSSVIYMVQLPIFGVIDTPCWIIKAAPSCSEKDGNYACLLREDQGWYCKNAGSTVYYPNEKDCETRGDHVFCDTAAGINVAEQSRECNINISTTNYPCKVSTGRHPISMVALSPLGALVACYKGVSCSIGSNRVGIIKQLPKGCSYITNQDADTVTIDNTVYQLSKVEGEQHVIKGRPVSSSFDPIRFPEDQFNVALDQVFESIENSQALVDQSNKILNSAEKGNTGFIIVIILIAVLGLTMISVSIIIIIKKTRKPTGAPPELNGVTNGGFIPHS

SEQ ID NO: 318 - DNA, 1620 bp, human metapneumo virus
atgtcttggaaagtggtgatcattttttcattgttaataacacctcaacacggtcttaaagagagctacttagaagagtcatgtagcactataactgaaggatatctcagtgttctgaggacaggttggtacaccaatgtttttacactggaggtaggcgatgtagagaaccttacatgtgccgatggacccagcttaataaaaacagaattagacctgaccaaaagtgcactaagagagctcagaacagtttctgctgatcaactggcaagagaggagcaaattgaaaatcccagacaatctagattcgttctaggagcaatagcactcggtgttgcaactgcagctgcagttacagcaggtgttgcaattgccaaaaccatccggcttgaaagtgaagtaacagcaattaagaatgccctcaaaaagaccaatgaagcagtatctacattggggaatggagttcgtgtgttggcaactgcagtgagagagctgaaagattttgtgagcaagaatctaacacgtgcaatcaacaaaaacaagtgcgacattgctgacctgaaaatggccgttagcttcagtcaattcaacagaaggttcctaaatgttgtgcggcaattttcagacaacgctggaataacaccagcaatatctttggacttaatgacagatgctgaactagccagagctgtttccaacatgccaacatctgcaggacaaataaaactgatgttggagaaccgtgcaatggtaagaagaaaagggttcggaatcctgataggagtttacggaagctccgtaatttacatggtgcaactgccaatctttggggttatagacacgccttgctggatagtaaaagcagccccttcttgttcaggaaaaaagggaaactatgcttgcctcttaagagaagaccaaggatggtattgtcaaaatgcagggtcaactgtttactacccaaatgaaaaagactgtgaaacaagaggagaccatgtcttttgcgacacagcagcaggaatcaatgttgctgagcagtcaaaggagtgcaacataaacatatctactactaattacccatgcaaagttagcacaggaagacatcctatcagtatggttgcactatctcctcttggggctttggttgcttgctacaagggagtgagctgttccattggcagcaacagagtagggatcatcaagcaactgaacaaaggctgctcttatataaccaaccaagacgcagacacagtgacaatagacaacactgtataccagctaagcaaagttgaaggcgaacagcatgttataaaaggaaggccagtgtcaagcagctttgacccagtcaagtttcctgaagatcaattcaatgttgcacttgaccaagttttcgagagcattgagaacagtcaggccttggtggatcaatcaaacagaatcctaagcagtgcagagaaaggaaacactggcttcatcattgtaataattctaattgctgtccttggctctaccatgatcctagtgagtgtttttatcataataaagaaaacaaagaaacccacaggagcacctccagagctgagtggtgtcacaaacaatggcttcataccacataattag

SEQ ID NO: 319 - DNA, 1620 bp, human metapneumo virus
atgtcttggaaagtggtgatcattttttcattgctaataacacctcaacacggtcttaaagagagctacctagaagaatcatgtagcactataactgagggatatcttagtgttctgaggacaggttggtataccaacgtttttacattagaggtgggtgatgtagaaaaccttacatgttctgatggacctagcctaataaaaacagaattagatctgaccaaaagtgcactaagagagctcaaaacagtctctgctgaccaattggcaagagaggaacaaattgagaatcccagacaatctaggtttgttctaggagcaatagcactcggtgttgcaacagcagctgcagtcacagcaggtgttgcaattgccaaaaccatccggcttgagagtgaagtcacagcaattaagaatgccctcaaaacgaccaatgaagcagtatctacattggggaatggagttcgagtgttggcaactgcagtgagagagctaaaagactttgtgagcaagaatttaactcgtgcaatcaacaaaaacaagtgcgacattgatgacctaaaaatggctgttagcttcagtcaattcaacagaaggtttctaaatgttgtgcggcaattttcagacaatgctggaataacaccagcaatatctttggacttaatgacagatgctgaactagccagggccgtttctaacatgccgacatctgcaggacaaataaaattgatgttggagaaccgtgcgatggtgcgaagaaaggggttcggaatcctgataggggtctacgggagctccgtaatttacacggtgcagctgccaatctttggcgttatagacacgccttgctggatagtaaaagcagccccttcttgttccgaaaaaaagggaaactatgcttgcctcttaagagaagaccaagggtggtattgtcagaatgcagggtcaactgtttactacccaaatgagaaagactgtgaaacaagaggagaccatgtcttttgcgacacagcagcaggaattaatgttgctgagcaatcaaaggagtgcaacatcaacatatccactacaaattacccatgcaaagtcagcacaggaagacatcctatcagtatggttgcactgtctcctcttggggctctggttgcttgctacaaaggagtaagctgttccattggcagcaacagagtagggatcatcaagcagctgaacaaaggttgctcctatataaccaaccaagatgcagacacagtgacaatagacaacactgtatatcagctaagcaaagttgagggtgaacagcatgttataaaaggcagaccagtgtcaagcagctttgatccaatcaagtttcctgaagatcaattcaatgttgcacttgaccaagtttttgagaacattgaaaacagccaggccttagtagatcaatcaaacagaatcctaagcagtgcagagaaagggaatactggctttatcattgtaataattctaattgctgtccttggctctagcatgatcctagtgagcatcttcattataatcaagaaaacaaagaaaccaacgggagcacctccagagctgagtggtgtcacaaacaatggcttcataccacacagttag

SEQ ID NO: 320 - DNA, 1620 bp, human metapneumo virus
atgtcttggaaagtgatgatcatcatttcgttactcataacaccccagcacgggctaaaggagagttatttggaagaatcatgtagtactataactgagggatacctcagtgttttaagaacaggctggtacactaatgtcttcacattagaagttggtgatgttgaaaatcttacatgtactgatggacctagcttaatcaaaacagaacttgatctaacaaaaagtgctttaagggaactcaaaacagtctctgctgatcagttggcgagagaggagcaaattgaaaatcccagacaatcaagatttgtcttaggtgcgatagctctcggagttgctacagcagcagcagtcacagcaggcattgcaatagccaaaaccataaggcttgagagtgaggtgaatgcaattaaaggtgctctcaaacaaactaatgaagcagtatccacattagggaatggtgtgcgggtcctagccactgcagtgagagagctaaaagaatttgtgagcaaaaacctgactagtgcaatcaacaggaacaaatgtgacattgctgatctgaagatggctgtcagcttcagtcaattcaacagaagatttctaaatgttgtgcggcagttttcagacaatgcagggataacaccagcaatatcattggacctgatgactgatgctgagttggccagagctgtatcatacatgccaacatctgcagggcagataaaactgatgttggagaaccgcgcaatggtaaggagaaaaggatttggaatcctgataggggtctacggaagctctgtgatttacatggttcaattgccgatctttggtgtcatagatacaccttgttggatcatcaaggcagctccctcttgctcagaaaaaaacgggaattatgcttgcctcctaagagaggatcaagggtggtattgtaaaaatgcaggatctactgtttactacccaaatgaaaaagactgcgaaacaagaggtgatcatgttttttgtgacacagcagcagggatcaatgttgctgagcaatcaagagaatgcaacatcaacatatctactaccaactacccatgcaaagtcagcacaggaagacaccctataagcatggttgcactatcacctctcggtgctttggtggcttgctataaaggggtaagctgctcgattggcagcaattgggttggaatcatcaaacaattacccaaaggctgctcatacataaccaaccaggatgcagacactgtaacaattgacaataccgtgtatcaactaagcaaagttgaaggtgaacagcatgtaataaaagggagaccagtttcaagcagttttgatccaatcaagtttcctgaggatcagttcaatgttgcgcttgatcaagtcttcgaaagcattgagaacagtcaggcactagtggaccagtcaaacaaaattctaaacagtgcagaaaaaggaaacactggtttcattatcgtagtaattttggttgctgttcttggtctaaccatgatttcagtgagcatcatcatcataatcaagaaaacaaggaagcccacaggagcacctccagagctgaatggtgtcaccaacggcggtttcataccacatagttag

SEQ ID NO: 321 - DNA, 1620 bp, human metapneumo virus
atgtcttggaaagtgatgattatcatttcgttactcataacacctcagcacggactaaaagaaagttatttagaagaatcatgtagtactataactgaaggatatctcagtgttttaagaacaggttggtacaccaatgtctttacattagaagttggtgatgttgaaaatcttacatgtactgatggacctagcttaatcaaaacagaacttgacctaaccaaaagtgctctgagagaactcaaaacagtttctgctgatcagttagcgagagaagaacaaattgaaaatcccagacaatcaaggtttgtcctaggtgcaatagctcttggagttgccacagcagcagcagtcacagcaggcattgcaatagccaaaaccataagacttgagagtgaagtgaatgcaatcaaaggtgctctcaaaacaaccaacgaggcagtatccacactaggaaatggagtgcgagtcctagccactgcagtaagagagctgaaagaatttgtgagcaaaaacctgactagtgcgatcaacaagaacaaatgtgacattgctgatctgaagatggctgtcagcttcagtcaattcaacagaagattcctaaatgttgtgcggcagttttcagacaatgcagggataacaccagcaatatcattggacctaatgactgatgctgagctggccagagctgtatcatacatgccaacatctgcaggacagataaaactaatgttagagaaccgtgcaatggtgaggagaaaaggatttggaatcttgataggggtctacggaagctctgtgatttacatggtccagctgccgatctttggtgtcatagatacaccttgttggataatcaaggcagctccctcttgttcagaaaaagatggaaattatgcttgcctcctaagagaggatcaagggtggtattgcaaaaatgcaggatccactgtttactacccaaatgaaaaagactgcgaaacaagaggtgatcatgttttttgtgacacagcagcagggatcaatgttgctgagcaatcaagagaatgcaacatcaacatatctaccaccaactacccatgcaaagtcagcacaggaagacaccctatcagcatggttgcactatcacctctcggtgctttggtagcttgctacaagggggttagctgctcgattggcagtaatcgggttggaataatcaaacaactacctaaaggctgctcatacataactaaccaggacgcagacactgtaacaattgacaacactgtgtatcaactaagcaaagttgagggtgaacagcatgtaataaaagggagaccagtttcaagcagttttgatccaatcaggtttcctgaggatcagttcaatgttgcgcttgatcaagtctttgaaagcattgaaaacagtcaagcactagtggaccagtcaaacaaaattctgaacagtgcagaaaaaggaaacactggtttcattattgtaataattttgattgctgttcttgggttaaccatgatttcagtgagcatcatcatcataatcaaaaaaacaaggaagcccacaggggcacctccagagctgaatggtgttaccaacggcggttttataccgcatagttag

SEQ ID NO: 322 - protein, 236 aa, human metapneumo virus; identical to SEQ ID NO: 119

SEQ ID NO: 323 - protein, 219 aa, human metapneumo virus
MEVKVENIRAIDMLKARVKNRVARSKCFKNASLILIGITTLSIALNIYLIINYTIQKTTSESEHHTSSPPTEPNKEASTISTDNPDINPSSQHPTQQSTENPTLNPAASASPSETEPASTPDTTNRLSSVDRSTAQPSESRTKTKPTVHTINNPNTASSTQSPPRTTTKAIRRATTFRMSSTGKRPTTTLVQSDSSTTTQNHEETGSANPQASASTMQN

SEQ ID NO: 324 - protein, 224 aa, human metapneumo virus
MEVRVENIRAIDMFKAKIKNRIRSSRCYRNATLILIGLTALSMALNIFLIIDHATLRNMIKTENCANMPSAEPSKKTPMTSTAGPNTKPNPQQATQWTTENSTSPVATPEGHPYTGTTQTSDTTAPQQTTDKHTAPLKSTNEQITQTTTEKKTIRATTQKREKGKENTNQTTSTAATQTTNTTNQIRNASETITTSDRPRTDTTTQSSEQTTRATDPSSPPHHA

SEQ ID NO: 325 - protein, 236 aa, human metapneumo virus; identical to SEQ ID NO: 146

SEQ ID NO: 326 - DNA, 708 bp, human metapneumo virus
gaggtgaaagtggagaacattcgaacaatagatatgctcaaagcaagagtaaaaaatcgtgtggcacgcagcaaatgctttaaaaatgcctctttggtcctcataggaataactacattgagtattgccctcaatatctatctgatcataaactataaaatgcaaaaaaacacatctgaatcagaacatcacaccagctcatcacccatggaatccagcagagaaactccaacggtccccacagacaactcagacaccaactcaagcccacagcatccaactcaacagtccacagaaggctccacactctactttgcagcctcagcaagctcaccagagacagaaccaacatcaacaccagatacaacaaaccgcccgcccttcgtcgacacacacacaacaccaccaagcgcaagcagaacaaagacaagtccggcagtccacacaaaaaacaacccaaggacaagctctagaacacattctccaccacgggcaacgacaaggacggcacgcagaaccaccactctccgcacaagcagcacaagaaagagaccgtccacagcatcagtccaacctgacatcagcgcaacaacccacaaaaacgaagaagcaagtccagcgagcccacaaacatctgcaagcacaacaagaatacaaaggaaaagcgtggaggccaacacatcaacaacatacaaccaaactagttaa

SEQ ID NO: 327 - DNA, 660 bp, human metapneumo virus
atggaggtgaaagtagagaacattcgagcaatagacatgctcaaagcaagagtgaaaaatcgtgtggcacgtagcaaatgctttaaaaatgcttctttaatcctcataggaataactacactgagtatagctctcaatatctatctgatcataaactacacaatacaaaaaaccacatccgaatcagaacaccacaccagctcaccacccacagaacccaacaaggaagcttcaacaatctccacagacaacccagacatcaatccaagctcacagcatccaactcaacagtccacagaaaaccccacactcaaccccgcagcatcagcgagcccatcagaaacagaaccagcatcaacaccagacacaacaaaccgcctgtcctccgtagacaggtccacagcacaaccaagtgaaagcagaacaaagacaaaaccgacagtccacacaatcaacaacccaaacacagcttccagtacacaatccccaccacggacaacaacgaaggcaatccgcagagccaccactttccgcatgagcagcacaggaaaaagaccaaccacaacattagtccagtccgacagcagcaccacaacccaaaatcatgaagaaacaggttcagcgaacccacaggcgtctgcaagcacaatgcaaaactag

SEQ ID NO: 328 - DNA, 675 bp, human metapneumo virus
atggaagtaagagtggagaacattcgagcgatagacatgttcaaagcaaagataaaaaaccgtataagaagcagcaggtgctatagaaatgctacactgatccttattggactaacagcgttaagcatggcacttaatattttcctgatcatcgatcatgcaacattaagaaacatgatcaaaacagaaaactgtgctaacatgccgtcggcagaaccaagcaaaaagaccccaatgacctccacagcaggcccaaacaccaaacccaatccacagcaagcaacacagtggaccacagagaactcaacatccccagtagcaaccccagagggccatccatacacagggacaactcaaacatcagacacaacagctccccagcaaaccacagacaaacacacagcaccgctaaaatcaaccaatgaacagatcacccagacaaccacagagaaaaagacaatcagagcaacaacccaaaaaagggaaaaaggaaaagaaaacacaaaccaaaccacaagcacagctgcaacccaaacaaccaacaccaccaaccaaatcagaaatgcaagtgagacaatcacaacatccgacagacccagaactgacaccacaacccaaagcagcgaacagacaacccgggcaacagacccaagctccccaccacaccatgcatag

SEQ ID NO: 329 - DNA, 711 bp, human metapneumo virus
atggaagtaagagtggagaacattcgggcaatagacatgttcaaagcaaaaatgaaaaaccgtataagaagtagcaagtgctatagaaatgctacactgatccttattggattaacagcattaagtatggcacttaatatttttttaatcattgattatgcaatgttaaaaaacatgaccaaagtggaacactgtgttaatatgccgccggtagaaccaagcaagaagaccccaatgacctctgcagtagacttaaacaccaaacccaatccacagcaggcaacacagttggccgcagaggattcaacatctctagcagcaacctcagaggaccatctacacacagggacaactccaacaccagatgcaacagtctctcagcaaaccacagacgagtacacaacattgctgagatcaaccaacagacagaccacccaaacaaccacagagaaaaagccaaccggagcaacaaccaaaaaagaaaccacaactcgaactacaagcacagctgcaacccaaacactcaacactaccaaccaaactagctatgtgagagaggcaaccacaacatccgccagatccagaaacagtgccacaactcaaagcagcgaccaaacaacccaggcagcagacccaagctcccaaccacaccatacacagaaaagcacaacaacaacatacaacacagacacatcctctccaagtagttaa

SEQ ID NO: 330 - protein, 2005 aa, human metapneumo virus
MDPLNESTVNVYLPDSYLKGVISFSETNAIGSCLLKRPYLKNDNTAKVAIENPVIEHVRLKNAVNSKMKISDYKIVEPVNMQHEIMKNVHSCELTLLKQFLTRSKNISTLKLNMICDWLQLKSTSDDTSILSFIDVEFIPSWVSNWFSNWYNLNKLILEFRKEEVIRTGSILCRSLGKLVFVVSSYGCIVKSNKSKRVSFFTYNQLLTWKDVMLSRFNANFCIWVSNSLNENQEGLGLRSNLQGILTNKLYETVDYMLSLCCNEGFSLVKEFEGFIMSEILRITEHAQFSTRFRNTLLNGLTDQLTKLKNKNRLRVHGTVLENNDYPMYEVVLKLLGDTLRCIKLLINKNLENAAELYYIFRIFGHPMVDERDAMDAVKLNNEITKILRWESLTELRGAFILRIIKGFVDNNKRWPKIKNLKVLSKRWTMYFKAKSYPSQLELSEQDFLELAAIQFEQEFSVPEKTNLEMVLNDKAISPPKRLIWSVYPKNYLPEKIKNRYLEETFNASDSLKTRRVLEYYLKDNKFDQKELKSYVVKQEYLNDKDHIVSLTGKERELSVGRMFAMQPGKQRQIQILAEKLLADNIVPFFPETLTKYGDLDLQRIMEIKSELSSIKTRRNDSYNNYIARASIVTDLSKFNQAFRYETTAICADVADELHGTQSLFCWLHLIVPMTTMICAYRHAPPETKGEYDIDKIEEQSGLYRYHMGGIEGWCQKLWTMEAISLLDVVSVKTRCQMTSLLNGDNQSIDVSKPVKLSEGLDEVKADYSLAVKMLKEIRDAYRNIGHKLKEGETYISRDLQFISKVIQSEGVMHPTPIKKILRVGPWINTILDDIKTSAESIGSLCQELEFRGESIIVSLILRNFWLYNLYMHESKQHPLAGKQLFKQLNKTLTSVQRFFEIKKENEVVDLWMNIPMQFGGGDPVVFYRSFYRRTPDFLTEAISHVDILLRISANIRNEAKISFFKALLSIEKNERATLTTLMRDPQAVGSERQAKVTSDINRTAVTSILSLSPNQLFSDSAIHYSRNEEEVGIIADNITPVYPHGLRVLYESLPFHKAEKVVNMISGTKSITNLLQRTSAINGEDIDRAVSMMLENLGLLSRILSVVVDSIEIPTKSNGRLICCQISRTLRETSWNNMEIVGVTSPSITTCMDVIYATSSHLKGIIIEKFSTDRTTRGQRGPKSPWVGSSTQEKKLVPVYNRQILSKQQREQLEAIGKMRWVYKGTPGLRRLLNKICLGSLGISYKCVKPLLPRFMSVNFLHRLSVSSRPMEFPASVPAYRTTNYHFDTSPINQALSERFGNEDINLVFQNAISCGISIMSVVEQLTGRSPKQLVLIPQLEEIDIMPPPVFQGKFNYKLVDKITSDQHIFSPDKIDMLTLGKMLMPTIKGQKTDQFLNKRENYFHGNNLIESLSAALACHWCGILTEQCIENNIFKKDWGDGFISDHAFMDFKIFLCVFKTKLLCSWGSQGKNIKDEDIVDESIDKLLRIDNTFWRMFSKVMFESKVKKRIMLYDVKFLSLVGYIGFKNWFIEQLRSAELHEVPWIVNAEGDLVEIKSIKIYLQLIEQSLFLRITVLNYTDMAHALTRLIRKKLMCDNALLTPIPSPMVNLTQVIDPTEQLAYFPKITFERLKNYDTSSNYAKGKLTRNYMILLPWQHVNRYNFVFSSTGCKVSLKTCIGKLMKDLNPKVLYFIGEGAGNWMARTACEYPDIKFVYRSLKDDLDHHYPLEYQRVIGELSRIIDSGEGLSMETTDATQKTHWDLIHRVSKDALLITLCDAEFKDRDDFFKMVILWRKHVLSCRICTTYGTDLYLFAKYHAKDCNVKLPFFVRSVATFIMQGSKLSGSECYILLTLGHHNNLPCHGEIQNSKMKIAVCNDFYAAKKLDNKSIEANCKSLLSGLRIPINKKELNRQRRLLTLQSNHSSVATVGGSKVIESKWLTNKANTIIDWLEHILNSPKGELNYDFFEALENTYPNMIKLIDNLGNAEIKKLIKVTGYMLVSKK

SEQ ID NO: 331 - protein, 2005 aa, human metapneumo virus
MDPLNESTVNVYLPDSYLKGVISFSETNAIGSCLLKRPYLKNDNTAKVAIENPVIEHVRLKNAVNSKMKISDYKVVEPVNMQHEIMKNVHSCELTLLKQFLTRSKNISTLKLNMICDWLQLKSTSDDTSILSFIDVEFIPSWVSNWFSNWYNLNKLILEFRREEVIRTGSILCRSLGKLVFIVSSYGCIVKSNKSKRVSFFTYNQLLTWKDVMLSRFNANFCIWVSNSLNENQEGLGLRSNLQGMLTNKLYETVDYMLSLCCNEGFSLVKEFEGFIMSEILRITEHAQFSTRFRNTLLNGLTDQLTKLKNKNRLRVHGTVLENNDYPMYEVVLKLLGDTLRCIKLLINKNLENAAELYYIFRIFGHPMVDERDAMDAVKLNNEITKILRLESLTELRGAFILRIIKGFVDNNKRWPKIKNLIVLSKRWTMYFKAKNYPSQLELSEQDFLELAAIQFEQEFSVPEKTNLEMVLNDKAISPPKRLIWSVYPKNYLPETIKNRYLEETFNASDSLKTRRVLEYYLKDNKFDQKELKSYVVRQEYLNDKEHIVSLTGKERELSVGRMFAMQPGKQRQIQILAEKLLADNIVPFFPETLTKYGDLDLQRIMEIKSELSSIKTRRNDSYNNYIARASIVTDLSKFNQAFRYETTAICADVADELHGTQSLFCWLHLIVPMTTMICAYRHAPPETKGEYDIDKIEEQSGLYRYHMGGIEGWCQKLWTMEAISLLDVVSVKTRCQMTSLLNGDNQSIDVSKPVKLSEGLDEVKADYRLAIKMLKEIRDAYRNIGHKLKEGETYISRDLQFISKVIQSEGVMHPTPIKKVLRVGPWINTILDDIKTSAESIGSLCQELEFRGESIIVSLILRNFWLYNLYMHESKQHPLAGKQLFKQLNKTLTSVQRFFEIKKENEVVDLWMNIPMQFGGGDPVVFYRSFYRRTPDFLTEAISHVDILLKISANIKNETKVSFFKALLSIEKNERATLTTLMRDPQAVGSERQAKVTSDINRTAVTSILSLSPNQLFSDSAIHYSRNEEEVGIIAENITPVYPHGLRVLYESLPFHKAEKVVNMISGTKSITNLLQRTSAINGEDIDRAVSMMLENLGLLSRILSVVVDSIEIPIKSNGRLICCQISRTLRETSWNNMEIVGVTSPSITTCMDVIYATSSHLKGIIIEKFSTDRTTRGQRGPKSPWVGSSTQEKKLVPVYNRQILSKQQREQLEAIGKMRWVYKGTPGLRRLLNKICLGSLGISYKCVKPLLPRFMSVNFLHRLSVSSRPMEFPASVPAYRTTNYHFDTSPINQALSERFGNEDINLVFQNAISCGISIMSVVEQLTGRSPKQLVLIPQLEEIDIMPPPVFQGKFNYKLVDKITSDQHIFSPDKIDMLTLGKMLMPTIKGQKTDQFLNKRENYFHGNNLIESLSAALACHWCGILTEQCIENNIFKKDWGDGFISDHAFMDFKIFLCVFKTKLLCSWGSQGKNIKDEDIVDESIDKLLRIDNTFWRMFSKVMFEPKVKKRIMLYDVKFLSLVGYIGFKNWFIEQLRSAELHEIPWIVNAEGDLVEIKSIKIYLQLIEQSLFLRITVLNYTDMAHALTRLIRKKLMCDNALLTPISSPMVNLTQVIDPTTQLDYFPKITFERLKNYDTSSNYAKGKLTRNYMILLPWQHVNRYNFVFSSTGCKVSLKTCIGKLMKDLNPKVLYFIGEGAGNWMARTACEYPDIKFVYRSLKDDLDHHYPLEYQRVIGELSRIIDSGEGLSMETTDATQKTHWDLIHRVSKDALLITLCDAEFKDRDDFFKMVILWRKHVLSCRICTTYGTDLYLFAKYHAKDCNVKLPFFVRSVATFIMQGSKLSGSECYILLTLGHHNSLPCHGEIQNSKMKIAVCNDFYAAKKLDNKSIEANCKSLLSGLRIPINKKELDRQRRLLTLQSNHSSVATVGGSKIIESKWLTNKASTIIDWLEHILNSPKGELNYDFFEALENTYPNMIKLIDNLGNAEIKKLIKVTGYMLVSKK

SEQ ID NO: 332 - protein, 2005 aa, human metapneumo virus
MDPFCESTVNVYLPDSYLKGVISFSETNAIGSCLLKRPYLKNDNTAKVAVENPVVEHVRLRNAVMTKMKISDYKVVEPVNMQHEIMKNIHSCELTLLKQFLTRSKNISSLKLNMICDWLQLKSTSDNTSILNFIDVEFIPVWVSNWFSNWYNLNKLILEFRREEVIRTGSILCRSLGKLVFIVSSYGCVVKSNKSKRVSFFTYNQLLTWKDVMLSRFNANFCIWVSNNLNKNQEGLGLRSNLQGMLTNKLYETVDYMLSLCCNEGFSLVKEFEGFIMSEILKITEHAQFSTRFRNTLLNGLTEQLSVLKAKNRSRVLGTILENNNYPMYEVVLKLLGDTLKSIKLLINKNLENAAELYYIFRIFGHPMVDEREAMDAVKLNNEITKILKLESLTELRGAFILRIIKGFVDNNKRWPKIKNLKVLSKRWAMYFKAKSYPSQLELSVQDFLELAAVQFEQEFSVPEKTNLEMVLNDKAISPPKKLIWSVYPKNYLPETIKNQYLEEAFNASDSQRTRRVLEFYLKDCKFDQKELKRYVIKQEYLNDKDHIVSLTGKERELSVGRMFAMQPGKQRQIQILAEKLLADNIVPFFPETLTKYGDLDLQRIMEIKSELSSIKTRKNDSYNNYIARASIVTDLSKFNQAFRYETTAICADVADELHGTQSLFCWLHLIVPMTTMICAYRHAPPETKGEYDIDKIQEQSGLYRYHMGGIEGWCQKLWTMEAISLLDVVSVKTRCQMTSLLNGDNQSIDVSKPVKLSEGIDEVKADYSLAIRMLKEIRDAYKNIGHKLKEGETYISRDLQFISKVIQSEGVMHPTPIKKILRVGPWINTILDDIKTSAESIGSLCQELEFRGESILVSLILRNFWLYNLYMYESKQHPLAGKQLFKQLNKTLTSVQRFFELKKENDVVDLWMNIPMQFGGGDPVVFYRSFYRRTPDFLTEAISHVDLLLKVSNNIKDETKIRFFKALLSIEKNERATLTTLMRDPQAVGSERQAKVTSDINRTAVTSILSLSPNQLFCDSAIHYSRNEEEVGIIADNITPVYPHGLRVLYESLPFHKAEKVVNMISGTKSITNLLQRTSAINGEDIDRAVSMMLENLGLLSRILSVIINSIEIPIKSNGRLICCQISKTLREKSWNNMEIVGVTSPSIVTCMDVVYATSSHLKGIIIEKFSTDKTTRGQRGPKSPWVGSSTQEKKLVPVYNRQILSKQQKEQLEAIGKMRWVYKGTPGLRRLLNKICIGSLGISYKCVKPLLPRFMSVNFLHRLSVSSRPMEFPASVPAYRTTNYHFDTSPINQALSERFGNEDINLVFQNAISCGISIMSVVEQLTGRSPKQLVLIPQLEEIDIMPPPVFQGKFNYKLVDKITSDQHIFSPDKIDILTLGKMLMPTIKGQKTDQFLNKRENYFHGNNLIESLSAALACHWCGILTEQCIENNIFRKDWGDGFISDHAFMDFKVFLCVFKTKLLCSWGSQGKNVKDEDIIDESIDKLLRIDNTFWRMFSKVMFESKVKKRIMLYDVKFLSLVGYIGFKNWFIEQLRVVELHEVPWIVNAEGELVEIKSIKIYLQLIEQSLSLRITVLNYTDMAHALTRLIRKKLMCDNALFNPSSSPMFNLTQVIDPTTQLDYFPRIIFERLKSYDTSSDYNKGKLTRNYMTLLPWQHVNRYNFVFSSTGCKVSLKTCIGKLIKDLNPKVLYFIGEGAGNWMARTACEYPDIKFVYRSLKDDLDHHYPLEYQRVIGDLNRVIDSGEGLSMETTDATQKTHWDLIHRISKDALLITLCDAEFKNRDDFFKMVILWRKHVLSCRICTAYGTDLYLFAKYHAVDCNIKLPFFVRSVATFIMQGSKLSGSECYILLTLGHHNNLPCHGEIQNSKMRIAVCNDFYASKKLDNKSIEANCKSLLSGLRIPINKKELNRQKKLLTLQSNHSSIATVGGSKIIESKWLKNKASTIIDWLEHILNSPKGELNYDFFEALENTYPNMIKLIDNLGNAEIKKLIKVTGYMLVSKK

SEQ ID NO: 333 - protein, 2005 aa, human metapneumo virus
MDPFCESTVNVYLPDSYLKGVISFSETNAIGSCLLKRPYLKKDNTAKVAVENPVVEHVRLRNAVMTKMKISDYKVVEPINMQHEIMKNIHSCELTLLKQFLTRSKNISSLKLSMICDWLQLKSTSDNTSILNFIDVEFIPVWVSNWFSNWYNLNKLILEFRREEVIRTGSILCRSLGKLVFIVSSYGCVVKSNKSKRVSFFTYNQLLTWKDVMLSRFNANFCIWVSNNLNKNQEGLGFRSNLQGMLTNKLYETVDYMLSLCSNEGFSLVKEFEGFIMSEILKITEHAQFSTRFRNTLLNGLTEQLSMLKAKNRSRVLGTILENNDYPMYEVVLKLLGDTLKSIKLLINKNLENAAELYYIFRIFGHPMVDEREAMDAVKLNNEITKILKLESLTELRGAFILRIIKGFVDNNKRWPKIKNLKVLSKRWVMYFKAKSYPSQLELSVQDFLELAAVQFEQEFSVPEKTNLEMVLNDKAISPPKKLIWSVYPKNYLPEIIKNQYLEEVFNASDSQRTRRVLEFYLKDCKFDQKDLKRYVLKQEYLNDKDHIVSLTGKERELSVGRMFAMQPGKQRQIQILAEKLLADNIVPFFPETLTKYGDLDLQRIMEMKSELSSIKTRKNDSYNNYIARASIVTDLSKFNQAFRYETTAICADVADELHGTQSLFCWLHLIVPMTTMICAYRHAPPETKGEYDIDKIEEQSGLYRYHMGGIEGWCQKLWTMEAISLLDVVSVKTRCQMTSLLNGDNQSIDVSKPVKLSEGIDEVKADYSLAIKMLKEIRDAYKNIGHKLKEGETYISRDLQFISKVIQSEGVMHPTPIKKILRVGPWINTILDDIKTSAESIGSLCQELEFRGESMLVSLILRNFWLYNLYMHESKQHPLAGKQLFKQLNKTLTSVQRFFELKKENDVVDLWMNIPMQFGGGDPVVFYRSFYRRTPDFLTEAISHVDLLLKVSNNIKNETKIRFFKALLSIEKNERATLTTLMRDPQAVGSERQAKVTSDINRTAVTSILSLSPNQLFCDSAIHYSRNEEEVGIIADNITPVYPHGLRVLYESLPFHKAEKVVNMISGTKSITNLLQRTSAINGEDIDRAVSMMLENLGLLSRILSVIINSIEIPIKSNGRLICCQISKTLREKSWNNMEIVGVTSPSIVTCMDVVYATSSHLKGIIIEKFSTDKTTRGQRGPKSPWVGSSTQEKKLVPVYNRQILSKQQKEQLEAIGKMRWVYKGTPGLRRLLNKICIGSLGISYKCVKPLLPRFMSVNFLHRLSVSSRPMEFPASVPAYRTTNYHFDTSPINQALSERFGNEDINLVFQNAISCGISIMSVVEQLTGRSPKQLVLIPQLEEIDIMPPPVFQGKFNYKLVDKITSDQHIFSPDKIDILTLGKMLMPTIKGQKTDQFLNKRENYFHGNNLIESLSAALACHWCGILTEQCVENNIFRKDWGDGFISDHAFMDFKIFLCVFKTKLLCSWGSQGKNVKDEDIIDESIDKLLRIDNTFWRMFSKVMFESKVKKRIMLYDVKFLSLVGYIGFKNWFIEQLRVVELHEVPWIVNAEGELVEIKPIKIYLQLIEQSLSLRITVLNYTDMAHALTRLIRKKLMCDNALFNPSSSPMFSLTQVIDPTTQLDYFPKVIFERLKSYDTSSDYNKGKLTRNYMTLLPWQHVNRYNFVFSSTGCKISLKTCIGKLIKDLNPKVLYFIGEGAGNWMARTACEYPDIKFVYRSLKDDLDHHYPLEYQRVIGDLNRVIDGGEGLSMETTDATQKTHWDLIHRISKDALLITLCDAEFKNRDDFFKMVILWRKHVLSCRICTAYGTDLYLFAKYHATDCNIKLPFFVRSVATFIMQGSKLSGSECYILLTLGHHNNLPCHGEIQNSKMRIAVCNDFHASKKLDNKSIEANCKSLLSGLRIPINKKELNRQKKLLTLQSNHSSIATVGGSKIIESKWLKNKASTIIDWLEHILNSPKGELNYDFFEALENTYPNMIKLIDNLGNAEIKKLIKVPGYMLVSKK

SEQ ID NO: 334 - DNA, 6018 bp, human metapneumo virus
atggatcctctcaatgaatccactgttaatgtctatcttcctgactcatatcttaaaggagtgatttcctttagtgagactaatgcaattggttcatgtctcttaaaaagaccttacctaaaaaatgacaacactgcaaaagttgccatagagaatcctgttatcgagcatgttagactcaaaaatgcagtcaattctaagatgaaaatatcagattacaagatagtagagccagtaaacatgcaacatgaaattatgaagaatgtacacagttgtgagctcacattattaaaacagtttttaacaaggagtaaaaatattagcactctcaaattaaatatgatatgtgattggctgcagttaaagtctacatcagatgatacctcaatcctaagttttatagatgtagaatttatacctagctgggtaagcaattggtttagtaattggtacaatctcaacaagttgattctggaattcaggaaagaagaagtaataagaactggttcaatcttgtgtaggtcattgggtaaattagtttttgttgtatcatcatatggatgtatagtcaagagcaacaaaagcaaaagagtgagcttcttcacatacaatcaactgttaacatggaaagatgtgatgttaagtagattcaatgcaaatttttgtatatgggtaagcaacagtctgaatgaaaatcaagaagggctagggttgagaagtaatctgcaaggcatattaactaataagctatatgaaactgtagattatatgcttagtttatgttgcaatgaaggtttctcacttgtgaaagagttcgaaggctttattatgagtgaaattcttaggattactgaacatgctcaattcagtactagatttagaaatactttattaaatggattaactgatcaattaacaaaattaaaaaataaaaacagactcagagttcatggtaccgtgttagaaaataatgattatccaatgtacgaagttgtacttaagttattaggagatactttgagatgtattaaattattaatcaataaaaacttagagaatgctgctgaattatactatatatttagaatattcggtcacccaatggtagatgaaagagatgcaatggatgctgtcaaattaaacaatgaaatcacaaaaatccttaggtgggagagcttgacagaactaagaggggcattcatattaaggattatcaaaggatttgtagacaacaacaaaagatggcccaaaattaaaaacttaaaagtgcttagtaagagatggactatgtacttcaaagcaaaaagttaccccagtcaacttgaattaagcgaacaagattttttagagcttgctgcaatacagtttgaacaagagttttctgtccctgaaaaaaccaaccttgagatggtattaaatgataaagctatatcacctcctaaaagattaatatggtctgtgtatccaaaaaattacttacctgagaaaataaaaaatcgatatctagaagagactttcaatgcaagtgatagtctcaaaacaagaagagtactagagtactatttgaaagataataaattcgaccaaaaagaacttaaaagttatgttgttaaacaagaatatttaaatgataaggatcatattgtctcgctaactggaaaagaaagagaattaagtgtaggtagaatgtttgctatgcaaccaggaaaacagcgacaaatacaaatattggctgaaaaattgttagctgataatattgtaccttttttcccagaaaccttaacaaagtatggtgatctagatcttcagagaataatggaaatcaaatcggaactttcttctattaaaactagaagaaatgatagttataataattacattgcaagagcatccatagtaacagatttaagtaagttcaaccaagcctttaggtatgaaactacagcgatctgtgcggatgtagcagatgaactacatggaacacaaagcctattctgttggttacatcttatcgtccctatgacaacaatgatatgtgcctatagacatgcaccaccagaaacaaaaggtgaatatgatatagataagatagaagagcaaagtggtttatatagatatcatatgggtggtattgaaggatggtgtcaaaaactctggacaatggaagctatatctctattagatgttgtatctgtaaaaacacgatgtcaaatgacatctttattaaacggtgacaaccaatcaatagatgtaagtaaaccagttaagttatctgagggtttagatgaagtgaaagcagattatagcttggctgtaaaaatgttaaaagaaataagagatgcatacagaaatataggccataaacttaaagaaggggaaacatatatatcaagagatcttcagtttataagtaaggtgattcaatctgaaggagtaatgcatcctacccctataaaaaagatcttaagagtgggaccatggataaacacaatattagatgacattaaaaccagtgcagagtcaatagggagtctatgtcaggaattagaatttaggggggaaagcataatagttagtctgatattaaggaatttttggctgtataatttatacatgcatgaatcaaagcaacaccccctagcagggaagcagttattcaaacaactaaataaaacattaacatcagtgcagagattttttgaaataaaaaaggaaaatgaagtagtagatctatggatgaacataccaatgcagtttggaggaggagatccagtagtcttctatagatctttctatagaaggacccctgattttttaactgaagcaatcagtcatgtggatattctgttaagaatatcagccaacataagaaatgaagcgaaaataagtttcttcaaagccttactgtcaatagaaaaaaatgaacgtgctacactgacaacactaatgagagatcctcaagctgttggctcagagcgacaagcaaaagtaacaagtgatatcaatagaacagcagttaccagcatcttaagtctttctccaaatcaacttttcagcgatagtgctatacactacagtagaaatgaagaagaggtcggaatcattgctgacaacataacacctgtttatcctcatggactgagagttttgtatgaatcattaccttttcataaagctgaaaaagttgtgaatatgatatcaggaacgaaatccataaccaacttattacagagaacatctgctattaatggtgaagatattgacagagctgtatccatgatgctggagaacctaggattattatctagaatattgtcagtagttgttgatagtatagaaattccaaccaaatctaatggtaggctgatatgttgtcagatatctagaaccctaagggagacatcatggaataatatggaaatagttggagtaacatcccctagcatcactacatgcatggatgtcatatatgcaactagctctcatttgaaagggataatcattgaaaagttcagcactgacagaactacaagaggtcaaagaggtccaaagagcccttgggtagggtcgagcactcaagagaaaaaattagttcctgtttataacagacaaattctttcaaaacaacaaagagaacagctagaagcaattggaaaaatgagatgggtatataaagggacaccaggtttaagacgattactcaataagatttgtcttggaagtttaggcattagttacaaatgtgtaaaacctttattacctaggtttatgagtgtaaatttcctacacaggttatctgtcagtagtagacctatggaattcccagcatcagttccagcttatagaacaacaaattaccattttgacactagtcctattaatcaagcactaagtgagagatttgggaatgaagatattaatttggtcttccaaaatgcaatcagctgtggaattagcataatgagtgtagtagaacaattaactggtaggagtccaaaacagttagttttaatacctcaattagaagaaatagacattatgccaccaccagtgtttcaagggaaattcaattataagctagtagataagataacttctgatcaacatatcttcagtccagacaaaatagatatgttaacactggggaaaatgctcatgcccactataaaaggtcagaaaacagatcagttcctgaacaagagagagaattatttccatgggaataatcttattgagtctttgtcagcagcgttagcatgtcattggtgtgggatattaacagagcaatgtatagaaaataatattttcaagaaagactggggtgacgggttcatatcggatcatgcttttatggacttcaaaatattcctatgtgtctttaaaactaaacttttatgtagttgggggtcccaagggaaaaacattaaagatgaagatatagtagatgaatcaatagataaactgttaaggattgataatactttttggagaatgttcagcaaggttatgtttgaatcaaaggttaagaaaaggataatgttatatgatgtaaaatttctatcattagtaggttatatagggtttaagaattggtttatagaacagttgagatcagctgagttgcatgaggtaccttggattgtcaatgccgaaggtgatctggttgagatcaagtcaattaaaatctatttgcaactgatagagcaaagtttatttttaagaataactgttttgaactatacagatatggcacatgctctcacaagattaatcagaaagaagttgatgtgtgataatgcactattaactccgattccatccccaatggttaatttaactcaagttattgatcctacagaacaattagcttatttccctaagataacatttgaaaggctaaaaaattatgacactagttcaaattatgctaaaggaaagctaacaaggaattacatgatactgttgccatggcaacatgttaatagatataactttgtctttagttctactggatgtaaagttagtctaaaaacatgcattggaaaacttatgaaagatctaaaccctaaagttctgtactttattggagaaggggcaggaaattggatggccagaacagcatgtgaatatcctgacatcaaatttgtatacagaagtttaaaagatgaccttgatcatcattatcctttggaataccagagagttataggagaattaagcaggataatagatagcggtgaagggctttcaatggaaacaacagatgcaactcaaaaaactcattgggatttgatacacagagtaagcaaagatgctttattaataactttatgtgatgcagaatttaaggacagagatgatttttttaagatggtaattctatggaggaaacatgtattatcatgcagaatttgcactacttatgggacagacctctatttattcgcaaagtatcatgctaaagactgcaatgtaaaattacctttttttgtgagatcagtagccacctttattatgcaaggtagtaaactgtcaggctcagaatgctacatactcttaacactaggccaccacaacaatttaccctgccatggagaaatacaaaattctaagatgaaaatagcagtgtgtaatgatttttatgctgcaaaaaaacttgacaataaatctattgaagccaactgtaaatcacttttatcagggctaagaataccgataaataagaaagaattaaatagacagagaaggttattaacactacaaagcaaccattcttctgtagcaacagttggaggtagcaaggtcatagagtctaaatggttaacaaacaaggcaaacacaataattgattggttagaacatattttaaattctccaaaaggtgaattaaattatgatttttttgaagcattagaaaatacttaccctaatatgattaaactaatagataatctagggaatgcagagataaaaaaactgatcaaagtaactggatatatgcttgtaagtaaaaaatga

SEQ ID NO: 335 - DNA, 6018 bp, human metapneumo virus
atggatcctcttaatgaatccactgttaatgtctatctccctgattcgtaccttaaaggagtaatttcttttagtgaaactaatgcaattggttcatgtctcttaaaaagaccttacttaaaaaatgacaacactgcaaaagttgccatagagaatcctgttattgagcatgtgagactcaaaaatgcagtcaattctaaaatgaaaatatcagattacaaggtagtagagccagtaaacatgcaacatgaaataatgaagaatgtacacagttgtgagctcacactattgaaacagtttttaacaaggagtaaaaacattagcactctcaaattaaatatgatatgtgattggctgcaattaaagtctacatcagatgatacctcaatcctaagtttcatagatgtagaatttatacctagttgggtaagcaactggtttagtaattggtacaatctcaataagttaattttggaattcagaagagaggaagtaataagaaccggttcaatcttatgcaggtcattgggtaaattagtttttattgtatcatcatacggatgtatcgtcaagagcaacaaaagcaaaagagtgagcttcttcacatacaatcaactgttaacatggaaagatgtgatgttaagtagatttaatgcgaatttttgtatatgggtaagcaatagtctgaatgaaaatcaggaagggctagggttaagaagtaatctacaaggtatgttaactaataaactatatgaaactgtagattatatgctaagtttatgttgcaatgaaggtttctcacttgtaaaagagttcgaaggttttattatgagtgaaatccttaggattactgaacatgctcaattcagtactagatttagaaatactttattaaatggattaacagatcaattaacaaaattaaaaaataaaaacagactcagagttcatggtaccgtattagaaaataatgattatccaatgtatgaagttgtacttaaattattaggagatactttgagatgtatcaaattattaatcaataaaaacttagagaatgctgcagaattatactatatattcagaatttttggtcatccaatggtagatgaaagagatgcaatggatgctgtcaaattaaacaatgaaatcacaaaaatcctaaggttggagagcttgacagaactaagaggagcattcatattaaggattatcaaaggatttgtggacaacaacaaaaggtggcccaaaattaaaaatttaatagtgcttagcaaaagatggactatgtacttcaaagctaaaaattatcccagtcaactcgaattaagtgaacaagactttctagagcttgctgcaatacaatttgaacaagagttttctgttcctgaaaaaaccaatcttgagatggtattaaatgacaaagccatatcacctcctaaaagattaatatggtctgtgtatccaaagaattacttacctgagacgataaaaaatcgatatttagaagaaactttcaatgcgagtgatagtctcaaaacaagaagagtactagagtactatttaaaagacaataaatttgatcaaaaggaacttaaaagttatgtagttagacaagaatatttaaatgataaggagcacattgtctcattaactggaaaagaaagagaattaagtgtaggtagaatgtttgctatgcaaccaggaaaacagcgacaaatacaaatattggcagaaaaattgttagctgataacattgtacctttcttcccggaaaccttaacaaagtatggtgatctagatcttcagagaataatggaaatcaaatcagaactttcttctatcaaaaccagaagaaatgacagttataataattacattgcaagagcatccatagtaacagatttgagcaagttcaaccaagcctttagatatgaaactacagcgatctgtgcggatgtagcagacgaattacatggaacacaaagcttattctgttggttacatcttatcgttcctatgactacaatgatatgtgcctatagacatgcaccaccagaaacaaaaggtgaatatgatatagataagatagaagagcaaagtggtctatatagatatcacatgggcggtattgaaggatggtgtcaaaaactctggacaatggaagctatatctttattggatgttgtatctgtaaagacacggtgtcaaatgacatctttattaaacggtgataaccaatcaatagatgtaagtaaaccagtcaagttatctgaaggtttagatgaagtgaaggcagattatcgcttagcaataaaaatgctaaaagaaataagagatgcatacagaaatataggccataaacttaaagaaggggaaacatatatatcaagggatcttcaatttataagcaaggtgattcaatctgaaggagtgatgcatcctacccctataaaaaaggtcttgagagtaggaccatggataaacacaatattagatgacattaaaactagtgctgagtcaatagggagtctatgtcaagaattagaatttaggggagaaagcataatagttagtctgatattaagaaacttctggctgtataacttatacatgcatgaatcaaagcaacatcctttggcagggaaacagttattcaaacaactaaataaaacattaacatcagtgcagagattttttgaaattaaaaaggaaaatgaggtagtagatctatggatgaacataccaatgcaatttggaggaggagatccagtagtcttctatagatctttctatagaaggacccctgattttttaactgaggcaatcagccatgtagatattctgttaaaaatatcagctaacataaaaaatgaaacgaaagtaagtttcttcaaagccttactatcaatagaaaaaaatgaacgtgctacactgacaacgctaatgagagatcctcaagctgttggatcagaacgacaagcaaaagtaacaagtgacatcaatagaacagcagttaccagtatcttaagtctttccccaaatcaacttttcagtgatagtgctatacactatagcaggaatgaagaagaagtgggaatcattgcagaaaacataacacctgtttatcctcatgggctgagagtattatatgaatcattgccctttcacaaagctgaaaaagttgtaaacatgatatcagggacaaaatctataaccaacttattacagagaacatccgctattaatggtgaagatattgacagggctgtatctatgatgttggagaatctaggattattatctagaatattgtcagtagttgttgatagtatagaaattccaatcaaatctaatggtaggctgatatgttgtcaaatctctaggactttaagagagacatcatggaataatatggaaatagttggagtaacatctcctagcatcactacatgtatggatgtcatatatgcaactagttctcatttgaaggggataattatagaaaagttcagcactgacagaactacaaggggtcaaagaggtccaaaaagcccttgggtagggtcgagtactcaagagaaaaaattagtacctgtttataacagacaaattctttcaaaacaacaaagagaacagctagaagcaattggaaaaatgagatgggtgtataaagggacaccaggcttgcgacgattactcaacaagatctgtcttgggagtttaggcattagttacaaatgtgtaaaacctttattacctaggtttatgagtgtaaatttcttacataggttatctgtcagtagtagacctatggaattcccagcatcagttccagcttatagaacaacaaattaccatttcgacactagtcctattaatcaagcactaagtgagagatttgggaatgaagatattaacttggtcttccaaaatgcgatcagctgtggaattagcataatgagtgtagtagaacaattaacaggtagaagcccaaaacagttagttttaataccccaattagaagaaatagacattatgccaccaccagtgtttcaagggaaattcaattataaattagtagataagataacttctgatcaacatatcttcagtccggacaaaatagatatgttaacactagggaaaatgctcatgcctactataaaaggtcagaaaacagatcagttcttaaataagagagagaattatttccatgggaacaatcttattgagtctttatcagcagcattagcatgtcattggtgtgggatattaacagaacaatgcatagaaaataatattttcaagaaggactggggtgacgggtttatatcagatcatgcttttatggacttcaaaatattcctatgtgtctttaaaactaaacttttatgtagttggggatcccaagggaaaaacattaaagatgaagatatagtagatgaatcaatagataaattgttaaggattgacaatactttttggagaatgttcagcaaagttatgtttgaaccaaaagttaagaaaaggataatgttatatgatgtaaaattcctatcactagtaggctacatagggtttaagaactggtttatagagcagttgagatcagctgaattgcatgaaataccttggattgtcaatgccgaaggtgatttggttgagatcaagtcaattaaaatctatttgcaactgatagaacaaagcttatttttaagaataactgttttgaactatacagatatggcacatgctctcacacgattaatcagaaagaagttaatgtgtgataatgcactgttaaccccaatttcatccccaatggttaacttaactcaagttattgatcccacaacacaattagattacttccccaagataacattcgaaaggctaaaaaattatgacacaagttcaaattatgctaaaggaaagctaacaagaaattacatgatactattgccatggcagcatgttaatagatataactttgtctttagttctactggatgtaaagttagtctgaaaacatgtattggaaaacttatgaaagacttaaatcctaaagttttgtactttattggagaaggagcaggaaattggatggccagaacagcatgtgaatatcctgatattaaatttgtatatagaagtctgaaagatgaccttgatcatcattatcctctggaataccagagagtgataggtgaattaagcagaatcatagatagtggtgaaggactttcaatggaaacaacagacgcaactcaaaaaactcattgggatttgatacacagggtaagcaaagatgctttattaataactttatgtgatgcagaatttaaggacagagatgatttttttaagatggtaattctatggagaaaacatgtattatcatgcagaatttgcactacttatgggacggacctctatttattcgcaaagtatcatgctaaagactgcaatgtaaaattacctttttttgtgagatcagttgctactttcattatgcagggtagtaagctgtcaggttcagaatgctacatactcttaacactaggccaccacaacagtttaccttgccatggagaaatacaaaattctaagatgaaaatagcagtgtgtaatgatttttatgctgcaaaaaaactcgacaataaatcaattgaagctaattgtaaatcacttttgtcagggctaagaatacctataaataagaaggaactagatagacagagaagattattaacactacaaagcaatcattcttctgtggcaacagttggcggtagcaagatcatagagtctaaatggttaacaaacaaagcaagtacaataattgattggttagaacatattttaaattctccaaagggcgaattaaattatgatttttttgaagcattggagaacacttaccctaatatgattaaactaatagataacttagggaatgcagagattaaaaaacttatcaaagtaacaggatacatgcttgtaagtaaaaaatga

SEQ ID NO: 336 - DNA, 6018 bp, human metapneumo virus
atggatcccttttgtgaatctactgttaatgtttatctccctgattcatatctcaaaggagtaatatcttttagtgaaaccaatgcaattggatcatgtcttttgaaaagaccctatctaaaaaatgacaacactgccaaagttgctgtagaaaaccctgttgttgaacatgtgaggcttagaaatgcagtcatgaccaaaatgaagatatcagattataaagtggttgaaccagttaatatgcagcatgaaataatgaaaaatatacatagttgtgagcttacattattaaaacaattcttaacgagaagcaaaaacattagctctctaaaattaaatatgatatgtgattggttacagttaaaatccacttcagataacacatcaattctcaattttatagatgtggagttcatacccgtttgggtaagcaattggttcagtaactggtataatctcaataaattaatcttagagtttagaagagaagaagtaataagaactggttcaattttatgtagatcactaggcaagttagtttttattgtatcatcttatggatgtgtagtaaaaagcaacaaaagtaaaagagtgagctttttcacctataaccaactgttaacatggaaagatgtgatgttaagtagattcaatgcaaacttttgtatatgggtaagtaacaacctgaacaaaaatcaagaaggactaggacttagaagcaatctgcaaggtatgttaaccaataaattatatgaaactgttgattacatgctaagcctatgctgcaatgaaggattctctctggtgaaagagtttgaaggatttattatgagtgaaattctaaaaattactgagcatgctcagttcagtactaggtttaggaatactttattgaatgggttaactgaacaattatcagtgttgaaagctaagaacagatctagagttcttggaactatattagaaaacaacaattaccctatgtacgaagtagtacttaaattattaggggacaccttgaaaagcataaagttattaattaacaagaatttagaaaatgctgcagaattatattatatattcagaatttttggacaccctatggtagatgagagggaagcaatggatgctgttaaattaaacaatgagattacaaaaattcttaaattagagagtttaacagaactaagaggagcatttatactaagaattataaaagggtttgtagacaataataaaagatggcctaaaattaagaatttaaaagtgctcagcaaaagatgggctatgtatttcaaagctaaaagttaccctagccaacttgagctaagtgtacaagattttttagaacttgctgcagtacaatttgagcaggaattctctgtacctgaaaaaaccaaccttgagatggtattaaatgataaagcaatatcacctccaaaaaagctaatatggtctgtatatccaaaaaactacctgcctgaaactataaaaaatcaatatttagaagaggctttcaatgcaagtgacagccaaagaacaaggagagtcttagaattttacttaaaagattgtaaatttgatcaaaaagaacttaaacgttatgtaattaaacaagagtatctgaatgacaaagaccacattgtctcgttaactgggaaggaaagagaattaagtgtaggtaggatgtttgcaatgcaaccaggaaaacaaagacagatacagatattagctgagaaacttctagctgataatattgtaccttttttcccagaaactttaacaaagtatggtgacttagatctccaaagaattatggaaataaaatcagaactttcttccattaaaactagaaagaatgatagctacaacaattatattgcaagggcctctatagtaacagacttaagtaagttcaatcaggcctttagatatgaaaccacagctatatgtgcagatgtagctgatgagttacatgggacacaaagcttattctgttggttacatcttattgttcccatgactacaatgatatgtgcatacagacatgcaccaccagaaacaaaaggggaatatgatatagacaaaatacaagagcaaagcggattatacagatatcatatgggagggattgaagggtggtgccagaagttatggacaatggaagcaatatccttgttagatgtagtatctgtgaagactcgctgtcagatgacctctctattaaacggagacaatcagtcaatagatgttagtaaaccagtaaaattgtctgaaggtatagatgaagtaaaagcagactatagcttagcaattagaatgcttaaagaaataagagatgcttataaaaacattggtcataaactcaaagaaggtgaaacatatatatcaagggatctccaatttataagtaaggtgattcaatctgaaggagtcatgcatcctacccctataaaaaagatattaagagtaggtccttggataaatacaatactagatgatattaaaaccagtgcagaatcaataggaagtctatgtcaagaactagaattcagaggggagagtatactagttagcttgatattaaggaatttctggctgtataacttgtacatgtatgagtcaaaacagcacccattagctgggaagcaactgttcaagcaattgaacaaaacattaacatctgtgcagagattttttgaactgaagaaagaaaatgatgtggttgacctatggatgaatataccaatgcagtttggagggggagatccagtagttttttacagatctttttacagaaggactcccgatttcctaactgaagcaatcagccatgtggatttactgttaaaagtgtcaaacaatatcaaagatgagactaagatacgatttttcaaagccttattatctatagaaaagaatgaacgtgctacattaacaacactaatgagagaccctcaggcagtaggatcagaacgacaagctaaggtaacaagtgatataaatagaacagcagttaccagcatactgagtctatctccgaatcagctcttctgtgatagtgctatacattatagtagaaatgaggaagaagttgggatcattgcagacaacataacacctgtctatcctcatgggctgagagtgctctatgaatcactaccttttcataaggctgaaaaggttgtcaatatgatatcaggcacaaagtctataactaatctattacagagaacatctgctatcaatggtgaagatattgatagagcagtgtctatgatgttagagaacttagggttgttatctagaatattgtcagtaataattaatagtatagaaataccaatcaagtccaatggcagattgatatgctgtcaaatttccaagaccttgagagaaaaatcatggaacaatatggaaatagtaggagtgacatctcctagtattgtgacatgtatggatgttgtgtatgcaactagttctcatttaaaaggaataattattgaaaaattcagtactgacaagaccacaagaggtcagaggggaccaaaaagcccctgggtaggatcaagcactcaagagaaaaaattggttcctgtttataatagacaaattctttcaaaacaacaaaaagagcaactggaagcaatagggaaaatgaggtgggtgtacaaaggaactccagggctaagaagattgctcaacaagatttgcataggaagcttaggtattagctataaatgtgtgaaacctttattaccaagattcatgagtgtaaacttcttacataggttatctgttagtagtagacccatggaattcccagcttctgttccagcttacaggacaacaaattaccattttgacactagtccaatcaaccaagcattaagtgagaggttcgggaacgaagacattaatttagtgttccaaaatgcaatcagctgcggaattagtataatgagtgttgtagaacagttaactggtagaagcccaaaacaattagtcctaatccctcaattagaagagatagatattatgcctcctcctgtatttcaaggaaaattcaattataaactagttgataagataacctccgatcaacacatcttcagtcctgacaaaatagacatattaacactagggaagatgcttatgcctaccataaaaggtcaaaaaactgatcagttcttaaataagagagaaaactattttcatggaaataatttaattgaatctttatctgcagcacttgcatgccactggtgtgggatattaacagaacagtgcatagaaaacaatatctttaggaaagattggggtgatgggttcatctcagatcatgccttcatggatttcaaggtatttctatgtgtatttaaaaccaaacttttatgtagttggggatctcaaggaaagaatgtaaaagatgaagatataatagatgaatccattgacaaattattaagaattgacaacaccttttggagaatgttcagcaaagtcatgtttgaatcaaaagtcaaaaaaagaataatgttatatgatgtgaaattcctatcattagtaggttatataggatttaaaaactggtttatagaacagttaagagtggtagaattgcatgaggtaccttggattgtcaatgctgaaggagagttagttgaaattaaatcaatcaaaatttatctgcagttaatagaacaaagtctatctttgagaataactgtattgaattatacagacatggcacatgctcttacacgattaattaggaaaaaattgatgtgtgataatgcactctttaatccaagttcatcaccaatgtttaatctaactcaggttattgatcccacaacacaactagactattttcctaggataatatttgagaggttaaaaagttatgataccagttcagactacaacaaagggaagttaacaaggaattacatgacattattaccatggcaacacgtaaacaggtacaattttgtctttagttctacaggttgtaaagtcagtttgaagacatgcatcgggaaattgataaaggatttaaatcctaaagttctttactttattggagaaggagcaggtaactggatggcaagaacagcatgtgaatatcctgatataaaatttgtatataggagtttaaaggatgaccttgatcaccattacccattagaatatcaaagggtaataggtgatctaaatagggtgatagatagtggtgaaggattatcaatggaaaccacagatgcaactcaaaaaactcattgggacttgatacacagaataagtaaagatgctttattgataacattgtgtgatgcagaattcaaaaacagagatgatttctttaagatggtaatcctttggagaaaacatgtattatcttgtagaatctgtacagcttatggaacagatctttacttatttgcaaagtatcatgcggtggactgcaatataaaattaccattttttgtaagatctgtagctacttttattatgcaaggaagcaaattatcagggtcagaatgttacatacttttaacattaggtcatcacaataatctaccctgtcatggagaaatacaaaattccaaaatgagaatagcagtgtgtaatgatttctatgcctcaaagaaactggacaacaaatcaattgaagcaaactgcaaatctcttctatcaggattgagaatacctataaacaaaaaggagttaaatagacaaaagaaattgttaacactacaaagtaaccattcttctatagcaacagttggcggcagtaagattatagaatccaaatggttaaagaataaagcaagtacaataattgattggttagagcatattttgaattctccaaaaggtgaattaaactatgatttctttgaagcattagagaacacataccccaatatgatcaagcttatagataatttgggaaatgcagaaataaagaaactaatcaaggtcactgggtatatgcttgtgagtaagaagtaa

SEQ ID NO: 337 - DNA, 6018 bp, human metapneumo virus
atggatccattttgtgaatccactgtcaatgtttatcttcctgactcatatctcaaaggagtaatatctttcagtgaaaccaatgcaattggctcatgccttttgaaaagaccctatctaaaaaaagataacactgctaaagttgctgtagaaaaccctgttgttgaacatgtcaggcttagaaatgcagtcatgaccaaaatgaagatatcagattataaagtggttgaaccaattaatatgcagcatgaaataatgaaaaatatacacagttgtgagctcacattattaaaacaattcttaacaagaagtaaaaacattagctctctaaaattaagtatgatatgtgattggttacagttaaaatccacctcagataacacatcaattcttaattttatagatgtggagtttatacctgtttgggtgagcaattggtttagtaactggtataatctcaataaattaatcttagagtttagaagagaggaagtaataagaactggttcaattttatgtagatcactaggcaagttagttttcattgtatcatcttatgggtgtgtagtaaaaagcaacaaaagtaaaagagtaagttttttcacatataaccaactgttaacatggaaagatgtgatgttaagtaggttcaatgcaaacttttgtatatgggtaagtaacaacctgaacaaaaatcaagaaggactaggatttagaagtaatctgcaaggtatgttaaccaataaattatatgaaactgttgattatatgttaagtctatgtagtaatgaagggttctcactagtgaaagagttcgaaggctttattatgagtgaaattcttaaaattactgagcatgctcaattcagtactaggtttaggaatactttattaaatgggttgactgaacaattatcaatgttgaaagctaaaaacagatctagagttcttggcactatattagaaaacaatgattaccccatgtatgaagtagtacttaaattattaggggacactttgaaaagtataaaattattaattaacaagaatttagaaaatgctgcagaattatattatatattcagaatttttggacaccctatggtagatgagagggaagcaatggatgctgttaaattaaataatgagattacaaaaattcttaaactggagagcttaacagaactaagaggagcatttatactaagaattataaaagggtttgtagataataataaaagatggcctaaaattaagaatttaaaagtgctcagtaaaagatgggttatgtatttcaaagccaaaagttaccctagccaacttgagctaagtgtacaagattttttagaacttgctgcagtacaattcgaacaggaattttctgtccctgaaaaaaccaaccttgagatggtattaaatgataaagcaatatctcctccaaaaaagttaatatggtcggtatatccaaaaaattatctacctgaaattataaaaaatcaatatttagaagaggtcttcaatgcaagtgacagtcaaagaacgaggagagtcttagaattttacttaaaagattgcaaatttgatcaaaaagaccttaaacgttatgtacttaaacaagagtatctaaatgacaaagaccacattgtctcattaactgggaaggaaagagaattaagtgtaggcaggatgtttgcaatgcaaccaggcaaacaaagacaaatacagatactagctgagaaacttctagctgataatattgtaccctttttcccagaaactttaacaaagtatggtgacttggatctccaaagaattatggaaatgaaatcagaactttcttccattaaaactaggaagaatgatagttacaacaattatattgcaagagcctccatagtaacagacctaagtaaattcaatcaagcctttagatatgaaaccacagctatctgtgcagatgtagcagatgagttacatggtacgcaaagcttattttgttggttacatcttattgttcccatgaccacaatgatatgtgcatacagacatgcaccaccagaaacaaagggggagtatgacatagacaaaatagaagagcaaagtgggctatacagatatcatatgggagggattgaagggtggtgtcagaagttatggacaatggaagcgatatccttgttagatgtagtatctgttaagactcgttgtcagatgacctctctattaaacggagacaatcaatcaatagatgtcagtaaaccagtaaaattgtctgaaggtatagatgaagtaaaagcagattatagcttagcaattaaaatgcttaaagagataagagatgcctataaaaacattggccataaactcaaagaaggtgaaacatatatatcaagagatctccaatttataagtaaggtgattcaatctgagggggtcatgcatcctacccccataaaaaagatattaagggtaggtccctggataaatacaatactagatgacattaaaaccagtgcagaatcaatagggagtctgtgtcaagaactagagttcagaggagaaagtatgctagttagcttgatattaaggaatttctggctgtataacttatacatgcatgagtcaaaacagcatccgttagctggaaaacaactgtttaagcaattgaacaaaacactaacatctgtgcaaagattttttgagctgaagaaagaaaatgatgtggttgacctatggatgaatataccaatgcagtttggagggggagacccagtagttttttacagatctttttacagaaggactcctgatttcctgactgaagcaatcagccatgtggatttactgttaaaagtttcgaacaatattaaaaatgagactaagatacgattctttaaagccttattatctatagaaaagaatgaacgtgcaacattaacaacactaatgagagacccccaggcggtaggatcggaaagacaagctaaggtaacaagtgatataaatagaacagcagttactagcatactgagtctatctccgaatcagctcttttgtgatagtgctatacactatagcagaaatgaagaagaagtcgggatcattgcagacaacataacacctgtttatcctcacggattgagagtgctctatgaatcactaccttttcataaggctgaaaaggttgtcaatatgatatcaggtacaaagtctataactaacctattgcagagaacatctgctatcaatggtgaagatattgatagagcagtgtctatgatgttagagaacttagggttgttatctaggatattgtcagtaataattaatagtatagaaataccaattaagtccaatggcagattgatatgctgtcaaatttctaagactttgagagaaaaatcatggaacaatatggaaatagtaggagtgacatctccaagtattgtaacatgtatggatgttgtgtatgcaactagttctcatttaaaaggaataattattgaaaaattcagtactgacaagaccacaagaggtcagaggggaccaaaaagcccctgggtaggatcaagcactcaagagaaaaaattagttcctgtttataatagacaaattctttcaaaacaacaaaaggagcaactggaagcaataggaaaaatgaggtgggtgtataaaggaactccagggctaagaagattgctcaataagatttgcataggaagtttaggtattagctataaatgtgtaaaacctctattaccaagattcatgagtgtaaacttcttacataggttatctgttagtagcagacccatggaattcccagcttctgttccagcttataggacaacaaattaccactttgacactagtccaatcaaccaagcattaagtgagaggttcgggaacgaagacattaatctagtgttccaaaatgcaatcagctgcggaattagtataatgagtgttgtagaacagttaactggtagaagcccaaaacaattagtcttaatcccccaattagaagagatagatattatgcctcctcctgtatttcaaggaaaattcaattataaactagttgataaaataacctctgatcaacacatcttcagtcctgacaaaatagacatattaacactagggaagatgcttatgcctactataaaaggtcaaaaaactgatcagttcttaaataagagagaaaactatttccatggaaataatttaattgaatctttatctgcagcacttgcatgccactggtgtggaatattaacagaacagtgtgtagaaaacaatatctttaggaaagactggggtgatgggttcatatcagatcatgccttcatggatttcaagatatttctatgtgtatttaaaaccaaacttttatgtagttggggatcccaagggaaaaatgtaaaagatgaagatataatagatgaatccattgacaaattattaagaattgacaacactttttggagaatgttcagcaaagtcatgtttgaatcaaaggtcaaaaaaagaataatgttatatgatgtaaaattcctatcattagtaggttatataggatttaaaaactggtttatagagcagttaagagtagtagaattgcatgaagtgccctggattgtcaatgctgaaggggagctagttgaaattaaaccaatcaaaatttatttgcagttaatagaacaaagtctatctttaagaataactgttttgaattatacagacatggcacatgctcttacacgattaattaggaagaaattgatgtgtgataatgcactcttcaatccaagttcatcaccaatgtttagtctaactcaagttatcgatcctacaacacagctagactattttcctaaggtgatatttgaaaggttaaaaagttatgataccagttcagactacaacaaagggaagttaacaagaaattacatgacattattaccatggcagcacgtaaacaggtataattttgtctttagttcaacaggatgtaaaatcagcttgaagacatgcatcgggaaattgataaaggacttaaaccctaaggttctttactttattggagaaggagcaggtaactggatggcaagaacagcatgtgagtatcctgacataaaatttgtatataggagtttaaaggatgatcttgatcatcattacccattagaatatcaaagggtaataggtgatttaaatagggtaatagatggtggtgaaggactatcaatggagaccacagatgcaactcaaaagactcattgggacttaatacacagaataagtaaagatgctttattgataacattgtgtgatgcagaattcaaaaacagagatgatttctttaaaatggtaattctttggagaaaacatgtattatcatgtagaatctgtacagcttatggaacagatctttacttatttgcaaagtatcatgcgacggactgcaatataaaattaccattttttgtaaggtctgtagctacttttattatgcaaggaagcaaattgtcaggatcagaatgttacatacttttaacattaggtcatcacaataatctgccatgccatggagaaatacaaaattccaaaatgagaatagcagtgtgtaatgatttccatgcctcaaaaaaactagacaacaaatcaattgaagctaactgtaaatctcttctatcaggattaagaataccaataaacaaaaaagagttaaatagacaaaagaaactgttaacactacaaagcaatcattcttccatagcaacagttggcggcagtaagattatagaatccaaatggttaaagaataaagcaagtacaataattgattggttagagcatatcttgaattctccaaaaggtgaattaaactatgatttctttgaagcattagagaacacataccccaatatgatcaagcttatagataacctgggaaatgcagagataaaaaaactaatcaaagttcctgggtatatgcttgtgagtaagaagtaa

SEQ ID NO: 338 - protein, 187 aa, human metapneumo virus
MSRKAPCKYEVRGKCNRGSECKFNHNYWSWPDRYLLIRSNYLLNQLLRNTDRADGLSIISGAGREDRTQDFVLGSTNVVQGYIDDNQSITKAAACYSLHNIIKQLQEVEVRQARDNKLSDSKHVALHNLVLSYMEMSKTPASLINNLKRLPREKLKKLAKLIIDLSAGAENDSSYALQDSESTNQVQ

SEQ ID NO: 339 - protein, 187 aa, human metapneumo virus
MSRKAPCKYEVRGKCNRGSECKFNHNYWSWPDRYLLIRSNYLLNQLLRNTDRADGLSIISGAGREDRTQDFVLGSTNVVQGYIDDNQSITKAAACYSLHNIIKQLQEVEVRQARDSKLSDSKHVALHNLILSYMEMSKTPASLINNLKRLPREKLKKLAKLIIDLSAGADNDSSYALQDSESTNQVQ

SEQ ID NO: 340 - protein, 187 aa, human metapneumo virus
MSRKAPCKYEVRGKCNRGSDCKFNHNYWSWPDRYLLLRSNYLLNQLLRNTDKADGLSIISGAGREDRTQDFVLGSTNVVQGYIDDNQGITKAAACYSLHNIIKQLQETEVRQARDNKLSDSKHVALHNLILSYMEMSKTPASLINNLKKLPREKLKKLARLIIDLSAGTDNDSSYALQDSESTNQVQ

SEQ ID NO: 341 - protein, 187 aa, human metapneumo virus
MSRKAPCKYEVRGKCNRGSECKFNHNYWSWPDRYLLLRSNYLLNQLLRNTDKADGLSIISGAGREDRTQDFVLGSTNVVQGYIDNNQGITKAAACYSLHNIIKQLQEIEVRQARDNKLSDSKHVALHNLILSYMEMSKTPASLINNLKKLPREKLKKLAKLIIDLSAGTDNDSSYALQDSESTNQVQ

SEQ ID NO: 342 - DNA, 564 bp, human metapneumo virus
atgtctcgcaaggctccgtgcaaatatgaagtgcggggcaaatgcaatagaggaagtgagtgcaagtttaaccacaattactggagttggccagatagatacttattaataagatcaaattatttattaaatcaacttttaaggaacactgatagagctgatggcttatcaataatatcaggagcaggcagagaagataggacacaagattttgtcctaggttccaccaatgtggttcaaggttatattgatgataaccaaagcataacaaaagctgcagcctgttacagtctacataatataatcaaacaactacaagaagttgaagttaggcaggctagagataacaaactatctgacagcaaacatgtagcacttcacaacttagtcctatcttatatggagatgagcaaaactcctgcatctttaatcaacaatctcaagagactgccgagagagaaactgaaaaaattagcaaagctcataattgacttatcagcaggtgctgaaaatgactcttcatatgccttgcaagacagtgaaagcactaatcaagtgcagtga

SEQ ID NO: 343 - DNA, 564 bp, human metapneumo virus
atgtctcgcaaggctccatgcaaatatgaagtgcggggcaaatgcaacagaggaagtgagtgtaagtttaaccacaattactggagttggccagatagatacttattaataagatcaaactatctattaaatcagcttttaaggaacactgatagagctgatggcctatcaataatatcaggcgcaggcagagaagacagaacgcaagattttgttctaggttccaccaatgtggttcaaggttatattgatgataaccaaagcataacaaaagctgcagcctgctacagtctacacaacataatcaagcaactacaagaagttgaagttaggcaggctagagatagcaaactatctgacagcaagcatgtggcactccataacttaatcttatcttacatggagatgagcaaaactcccgcatctttaatcaacaatcttaaaagactgccgagagaaaaactgaaaaaattagcaaagctgataattgacttatcagcaggcgctgacaatgactcttcatatgccctgcaagacagtgaaagcactaatcaagtgcagtga

SEQ ID NO: 344 - DNA, 564 bp, human metapneumo virus
atgtctcgtaaggctccatgcaaatatgaagtgcggggcaaatgcaacagagggagtgattgcaaattcaatcacaattactggagttggcctgatagatatttattgttaagatcaaattatctcttaaatcagcttttaagaaacacagataaggctgatggtttgtcaataatatcaggagcaggtagagaagatagaactcaagactttgttcttggttctactaatgtggttcaagggtacattgatgacaaccaaggaataaccaaggctgcagcttgctatagtctacacaacataatcaagcaactacaagaaacagaagtaagacaggctagagacaacaagctttctgatagcaaacatgtggcgctccacaacttgatattatcctatatggagatgagcaaaactcctgcatctctaatcaacaacctaaagaaactaccaagggaaaaactgaagaaattagcaagattaataattgatttatcagcaggaactgacaatgactcttcatatgccttgcaagacagtgaaagcactaatcaagtgcagtaa

SEQ ID NO: 345 - DNA, 564 bp, human metapneumo virus
atgtctcgcaaagctccatgcaaatatgaagtacggggcaagtgcaacaggggaagtgagtgcaaattcaaccacaattactggagctggcctgataggtatttattgttaagatcaaattatctcttgaatcagcttttaagaaacactgataaggctgatggtttgtcaataatatcaggagcaggtagagaagataggactcaagactttgttcttggttctactaatgtggttcaagggtacattgataacaatcaaggaataacaaaggctgcagcttgctatagtctacataacataataaaacagctacaagaaatagaagtaagacaggctagagataataagctttctgacagcaaacatgtggcacttcacaacttgatattatcctatatggagatgagcaaaactcctgcatccctgattaataacctaaagaaactaccaagagaaaaactgaagaaattagcgaaattaataattgatttatcagcaggaactgataatgactcttcatatgccttgcaagacagtgaaagcactaatcaagtgcagtaa

SEQ ID NO: 346 - protein, 71 aa, human metapneumo virus
MTLHMPCKTVKALIKCSEHGPVFITIEVDDMIWTHKDLKEALSDGIVKSHTNIYNCYLENIEIIYVKAYLS

SEQ ID NO: 347 - protein, 71 aa, human metapneumo virus
MTLHMPCKTVKALIKCSEHGPVFITIEVDEMIWTQKELKEALSDGIVKSHTNIYNCYLENIEIIYVKAYLS

SEQ ID NO: 348 - protein, 71 aa, human metapneumo virus
MTLHMPCKTVKALIKCSKHGPKFITIEADDMIWTHKELKETLSDGIVKSHTNIYSCYLENIEIIYVKTYLS

SEQ ID NO: 349 - protein, 71 aa, human metapneumo virus
MTLHMPCKTVKALIKCSKHGPKFITIEADDMIWTHKELKETLSDGIVKSHTNIYSCYLENIEIIYVKAYLS

SEQ ID NO: 350 - DNA, 216 bp, human metapneumo virus
atgactcttcatatgccttgcaagacagtgaaagcactaatcaagtgcagtgagcatggtccagttttcattactatagaggttgatgacatgatatggactcacaaggacttaaaagaagctttatctgatgggatagtgaagtctcatactaacatttacaattgttatttagaaaacatagaaattatatatgtcaaggcttacttaagttag

SEQ ID NO: 351 - DNA, 216 bp, human metapneumo virus
atgactcttcatatgccctgcaagacagtgaaagcactaatcaagtgcagtgagcatggtcctgttttcattactatagaggttgatgaaatgatatggactcaaaaagaattaaaagaagctttgtccgatgggatagtgaagtctcacaccaacatttacaattgttatttagaaaacatagaaattatatatgtcaaggcttacttaagttag

SEQ ID NO: 352 - DNA, 216 bp, human metapneumo virus
atgactcttcatatgccttgcaagacagtgaaagcactaatcaagtgcagtaaacatggtcccaaattcattaccatagaggcagatgatatgatatggactcacaaagaattaaaagaaacactgtctgatgggatagtaaaatcacacaccaatatttatagttgttacttagaaaatatagaaataatatatgttaaaacttacttaagttag

SEQ ID NO: 353 - DNA, 216 bp, human metapneumo virus
atgactcttcatatgccttgcaagacagtgaaagcactaatcaagtgcagtaagcatggtcccaaattcattaccatagaggcagatgatatgatatggacacacaaagaattaaaggagacactgtctgatgggatagtaaaatcacacaccaatatttacagttgttatttagaaaatatagaaataatatatgttaaagcttacttaagttag

SEQ ID NO: 354 - DNA, 727 bp, human metapneumo virus
atgtctcgcaaggctccgtgcaaatatgaagtgcggggcaaatgcaatagaggaagtgagtgcaagtttaaccacaattactggagttggccagatagatacttattaataagatcaaattatttattaaatcaacttttaaggaacactgatagagctgatggcttatcaataatatcaggagcaggcagagaagataggacacaagattttgtcctaggttccaccaatgtggttcaaggttatattgatgataaccaaagcataacaaaagctgcagcctgttacagtctacataatataatcaaacaactacaagaagttgaagttaggcaggctagagataacaaactatctgacagcaaacatgtagcacttcacaacttagtcctatcttatatggagatgagcaaaactcctgcatctttaatcaacaatctcaagagactgccgagagagaaactgaaaaaattagcaaagctcataattgacttatcagcaggtgctgaaaatgactcttcatatgccttgcaagacagtgaaagcactaatcaagtgcagtgagcatggtccagttttcattactatagaggttgatgacatgatatggactcacaaggacttaaaagaagctttatctgatgggatagtgaagtctcatactaacatttacaattgttatttagaaaacatagaaattatatatgtcaaggcttacttaagttag

SEQ ID NO: 355 - DNA, 727 bp, human metapneumo virus
atgtctcgcaaggctccatgcaaatatgaagtgcggggcaaatgcaacagaggaagtgagtgtaagtttaaccacaattactggagttggccagatagatacttattaataagatcaaactatctattaaatcagcttttaaggaacactgatagagctgatggcctatcaataatatcaggcgcaggcagagaagacagaacgcaagattttgttctaggttccaccaatgtggttcaaggttatattgatgataaccaaagcataacaaaagctgcagcctgctacagtctacacaacataatcaagcaactacaagaagttgaagttaggcaggctagagatagcaaactatctgacagcaagcatgtggcactccataacttaatcttatcttacatggagatgagcaaaactcccgcatctttaatcaacaatcttaaaagactgccgagagaaaaactgaaaaaattagcaaagctgataattgacttatcagcaggcgctgacaatgactcttcatatgccctgcaagacagtgaaagcactaatcaagtgcagtgagcatggtcctgttttcattactatagaggttgatgaaatgatatggactcaaaaagaattaaaagaagctttgtccgatgggatagtgaagtctcacaccaacatttacaattgttatttagaaaacatagaaattatatatgtcaaggcttacttaagttag

SEQ ID NO: 356 - DNA, 727 bp, human metapneumo virus
atgtctcgtaaggctccatgcaaatatgaagtgcggggcaaatgcaacagagggagtgattgcaaattcaatcacaattactggagttggcctgatagatatttattgttaagatcaaattatctcttaaatcagcttttaagaaacacagataaggctgatggtttgtcaataatatcaggagcaggtagagaagatagaactcaagactttgttcttggttctactaatgtggttcaagggtacattgatgacaaccaaggaataaccaaggctgcagcttgctatagtctacacaacataatcaagcaactacaagaaacagaagtaagacaggctagagacaacaagctttctgatagcaaacatgtggcgctccacaacttgatattatcctatatggagatgagcaaaactcctgcatctctaatcaacaacctaaagaaactaccaagggaaaaactgaagaaattagcaagattaataattgatttatcagcaggaactgacaatgactcttcatatgccttgcaagacagtgaaagcactaatcaagtgcagtaaacatggtcccaaattcattaccatagaggcagatgatatgatatggactcacaaagaattaaaagaaacactgtctgatgggatagtaaaatcacacaccaatatttatagttgttacttagaaaatatagaaataatatatgttaaaacttacttaagttag

SEQ ID NO: 357 - DNA, 727 bp, human metapneumo virus
atgtctcgcaaagctccatgcaaatatgaagtacggggcaagtgcaacaggggaagtgagtgcaaattcaaccacaattactggagctggcctgataggtatttattgttaagatcaaattatctcttgaatcagcttttaagaaacactgataaggctgatggtttgtcaataatatcaggagcaggtagagaagataggactcaagactttgttcttggttctactaatgtggttcaagggtacattgataacaatcaaggaataacaaaggctgcagcttgctatagtctacataacataataaaacagctacaagaaatagaagtaagacaggctagagataataagctttctgacagcaaacatgtggcacttcacaacttgatattatcctatatggagatgagcaaaactcctgcatccctgattaataacctaaagaaactaccaagagaaaaactgaagaaattagcgaaattaataattgatttatcagcaggaactgataatgactcttcatatgccttgcaagacagtgaaagcactaatcaagtgcagtaagcatggtcccaaattcattaccatagaggcagatgatatgatatggacacacaaagaattaaaggagacactgtctgatgggatagtaaaatcacacaccaatatttacagttgttatttagaaaatatagaaataatatatgttaaagcttacttaagttag

SEQ ID NO: 358 - protein, 254 aa, human metapneumo virus
MESYLVDTYQGIPYTAAVQVDLIEKDLLPASLTIWFPLFQANTPPAVLLDQLKTLTITTLYAASQNGPILKVNASAQGAAMSVLPKKFEVNATVALDEYSKLEFDKLTVCEVKTVYLTTMKPYGMVSKFVSSAKSVGKKTHDLIALCDFMDLEKNTPVTIPAFIKSVSIKESESATVEAAISSEADQALTQAKIAPYAGLIMIMTMNNPKGIFKKLGAGTQVIVELGAYVQAESISKICKTWSHQGTRYVLKSR

SEQ ID NO: 359 - protein, 254 aa, human metapneumo virus
MESYLVDTYQGIPYTAAVQVDLVEKDLLPASLTIWFPLFQANTPPAVLLDQLKTLTITTLYAASQSGPILKVNASAQGAAMSVLPKKFEVNATVALDEYSKLEFDKLTVCEVKTVYLTTMKPYGMVSKFVSSAKSVGKKTHDLIALCDFMDLEKNTPVTIPAFIKSVSIKESESATVEAAISSEADQALTQAKIAPYAGLIMIMTMNNPKGIFKKLGAGTQVIVELGAYVQAESISKICKTWSHQGTRYVLKSS

SEQ ID NO: 360 - protein, 254 aa, human metapneumo virus
MESYLVDTYQGIPYTAAVQVDLVEKDLLPASLTIWFPLFQANTPPAVLLDQLKTLTITTLYAASQNGPILKVNASAQGAAMSVLPKKFEVNATVALDEYSKLDFDKLTVCDVKTVYLTTMKPYGMVSKFVSSAKSVGKKTHDLIALCDFMDLEKNIPVTIPAFIKSVSIKESESATVEAAISSEADQALTQAKIAPYAGLIMIMTMNNPKGIFKKLGAGTQVIVELGAYVQAESISRICKSWSHQGTRYVLKSR

SEQ ID NO: 361 - protein, 254 aa, human metapneumo virus; identical to SEQ ID NO: 360

SEQ ID NO: 362 - DNA, 765 bp, human metapneumo virus
atggagtcctacctagtagacacctatcaaggcattccttacacagcagctgttcaagttgatctaatagaaaaggacctgttacctgcaagcctaacaatatggttccctttgtttcaggccaacacaccaccagcagtgctgctcgatcagctaaaaaccctgacaataaccactctgtatgctgcatcacaaaatggtccaatactcaaagtgaatgcatcagcccaaggtgcagcaatgtctgtacttcccaaaaaatttgaagtcaatgcgactgtagcactcgatgaatatagcaaactggaatttgacaaactcacagtctgtgaagtaaaaacagtttacttaacaaccatgaaaccatacgggatggtatcaaaatttgtgagctcagccaaatcagttggcaaaaaaacacatgatctaatcgcactatgtgattttatggatctagaaaagaacacacctgttacaataccagcattcatcaaatcagtttcaatcaaagagagtgagtcagctactgttgaagctgctataagcagtgaagcagaccaagctctaacacaggccaaaattgcaccttatgcgggattaattatgatcatgactatgaacaatcccaaaggcatattcaaaaagcttggagctgggactcaagtcatagtagaactaggagcatatgtccaggctgaaagcataagcaaaatatgcaagacttggagccatcaagggacaagatatgtcttgaagtccagataa

SEQ ID NO: 363 - DNA, 765 bp, human metapneumo virus
atggagtcctatctggtagacacttatcaaggcatcccttacacagcagctgttcaagttgatctagtagaaaaggacctgttacctgcaagcctaacaatatggttccccttgtttcaggccaatacaccaccagcagttctgcttgatcagctaaagactctgactataactactctgtatgctgcatcacaaagtggtccaatactaaaagtgaatgcatcagcccagggtgcagcaatgtctgtacttcccaaaaagtttgaagtcaatgcgactgtagcacttgacgaatatagcaaattagaatttgacaaacttacagtctgtgaagtaaaaacagtttacttaacaaccatgaaaccatatgggatggtatcaaagtttgtgagctcggccaaatcagttggcaaaaaaacacatgatctaatcgcattatgtgattttatggatctagaaaagaacacaccagttacaataccagcatttatcaaatcagtttctatcaaggagagtgaatcagccactgttgaagctgcaataagcagtgaagcagaccaagctctaacacaagccaaaattgcaccttatgcgggactgatcatgattatgaccatgaacaatcccaaaggcatattcaagaagcttggagctgggacccaagttatagtagaactaggagcatatgtccaggctgaaagcataagtaaaatatgcaagacttggagccatcaaggaacaagatatgtgctgaagtccagttaa

SEQ ID NO: 364 - DNA, 765 bp, human metapneumo virus
atggagtcctatctagtagacacttatcaaggcattccatatacagctgctgttcaagttgacctggtagaaaaagatttactgccagcaagtttgacaatatggtttcctttatttcaggccaacacaccaccagcagttctgcttgatcagctaaaaaccttgacaataacaactctgtatgctgcatcacagaatggtccaatactcaaggtaaatgcatctgcccaaggtgctgccatgtctgtacttcccaaaaaattcgaggtaaatgcaactgtagcacttgatgaatacagtaaacttgattttgacaagctgacggtctgcgatgttaaaacagtttatttgacaactatgaaaccgtacgggatggtgtcaaaatttgtgagttcagccaaatcagttggcaaaaagacacatgatctaattgcactatgtgacttcatggacctagagaaaaatatacctgtgacaataccagcattcataaagtcagtttcaatcaaagagagtgaatcagccactgttgaagctgcaataagcagcgaagccgaccaagccttgacacaagccaagattgcgccctatgcaggactaattatgatcatgaccatgaacaatccaaaaggtatattcaagaaactaggggctggaacacaagtgatagtagagctgggggcatatgttcaggctgagagcatcagtaggatctgcaagagctggagtcaccaaggaacaagatacgtactaaaatccagataa

SEQ ID NO: 365 - DNA, 765 bp, human metapneumo virus
atggagtcctatctagtggacacttatcaaggcattccctacacagctgctgttcaagttgatctggtagaaaaagacttactaccagcaagtttgacaatatggtttcctctattccaagccaacacaccaccagcggttttgctcgatcagctaaaaaccttgactataacaactctgtatgctgcatcacagaatggtccaatactcaaagtaaatgcatcagctcagggtgctgctatgtctgtacttcccaaaaaattcgaagtaaatgcaactgtggcacttgatgaatacagcaaacttgactttgacaagttaacggtttgcgatgttaaaacagtttatttgacaaccatgaagccatatgggatggtgtcaaaatttgtgagttcagccaaatcagttggcaaaaagacacatgatctaattgcactgtgtgacttcatggacctagagaaaaatatacctgtgacaataccagcattcataaagtcagtttcaatcaaagagagtgagtcagccactgttgaagctgcaataagcagtgaggccgaccaagcattaacacaagccaaaattgcaccctatgcaggactaatcatgatcatgaccatgaacaatccaaaaggtatattcaagaaactaggagctggaacacaagtgatagtagagctaggggcatatgttcaagccgagagcatcagcaggatctgcaagagctggagtcaccaaggaacaagatatgtactaaaatccagataa

SEQ ID NO: 366 - protein, 394 aa, human metapneumo virus
MSLQGIHLSDLSYKHAILKESQYTIKRDVGTTTAVTPSSLQQEITLLCGEILYAKHADYKYAAEIGIQYISTALGSERVQQILRNSGSEVQVVLTRTYSLGKIKNNKGEDLQMLDIHGVEKSWVEEIDKEARKTMATLLKESSGNIPQNQRPSAPDTPIILLCVGALIFTKLASTIEVGLETTVRRANRVLSDALKRYPRMDIPKIARSFYDLFEQKVYHRSLFIEYGKALGSSSTGSKAESLFVNIFMQAYGAGQTMLRWGVIARSSNNIMLGHVSVQAELKQVTEVYDLVREMGPESGLLHLRQSPKAGLLSLANCPNFASVVLGNASGLGIIGMYRGRVPNTELFSAAESYAKSLKESNKINFSSLGLTDEEKEAAEHFLNVSDDSQNDYE

SEQ ID NO: 367 - protein, 394 aa, human metapneumo virus
MSLQGIHLSDLSYKHAILKESQYTIKRDVGTTTAVTPSSLQQEITLLCGEILYAKHADYKYAAEIGIQYISTALGSERVQQILRNSGSEVQVVLTRTYSLGKVKNNKGEDLQMLDIHGVEKSWVEEIDKEARKTMATLLKESSGNIPQNQRPSAPDTPIILLCVGALIFTKLASTIEVGLETTVRRANRVLSDALKRYPRMDIPKIARSFYDLFEQKVYYRSLFIEYGKALGSSSTGSKAESLFVNIFMQAYGAGQTMLRWGVIARSSNNIMLGHVSVQAELKQVTEVYDLVREMGPESGLLHLRQSPKAGLLSLANCPNFASVVLGNASGLGIIGMYRGRVPNTELFSAAESYAKSLKESNKINFSSLGLTDEEKEAAEHFLNVSDDSQNDYE

SEQ ID NO: 368 - protein, 394 aa, human metapneumo virus
MSLQGIHLSDLSYKHAILKESQYTIKRDVGTTTAVTPSSLQQEITLLCGEILYTKHTDYKYAAEIGIQYICTALGSERVQQILRNSGSEVQVVLTKTYSLGKGKNSKGEELQMLDIHGVEKSWIEEIDKEARKTMVTLLKESSGNIPQNQRPSAPDTPIILLCVGALIFTKLASTIEVGLETTVRRANRVLSDALKRYPRIDIPKIARSFYELFEQKVYYRSLFIEYGKALGSSSTGSKAESLFVNIFMQAYGAGQTLLRWGVIARSSNNIMLGHVSVQSELKQVTEVYDLVREMGPESGLLHLRQSPKAGLLSLANCPNFASVVLGNASGLGIIGMYRGRVPNTELFSAAESYARSLKESNKINFSSLGLTDEEKEAAEHFLNMSGDNQNDYE

SEQ ID NO: 369 - protein, 394 aa, human metapneumo virus
MSLQGIHLSDLSYKHAILKESQYTIKRDVGTTTAVTPSSLQQEITLLCGEILYTKHTDYKYAAEIGIQYICTALGSERVQQILRNSGSEVQVVLTKTYSLGKGKNSKGEELQMLDIHGVEKSWVEEIDKEARKTMVTLLKESSGNIPQNQRPSAPDTPIILLCVGALIFTKLASTIEVGLETTVRRANRVLSDALKRYPRVDIPKIARSFYELFEQKVYYRSLFIEYGKALGSSSTGSKAESLFVNIFMQAYGAGQTMLRWGVIARSSNNIMLGHVSVQAELKQVTEVYDLVREMGPESGLLHLRQSPKAGLLSLANCPNFASVVLGNASGLGIIGMYRGRVPNTELFSAAESYARSLKESNKINFSSLGLTDEEKEAAEHFLNMSDDNQDDYE

SEQ ID NO: 370 - DNA, 1185 bp, human metapneumo virus
atgtctcttcaagggattcacctgagtgatttatcatacaagcatgctatattaaaagagtctcagtacacaataaaaagagatgtgggtacaacaactgcagtgacaccctcatcattgcaacaagaaataacactgttgtgtggagaaattctgtatgctaaacatgctgactacaaatatgctgcagaaataggaatacaatatattagcacagctttaggatcagagagagtgcagcagattctgaggaactcaggcagtgaagtccaagtggtcttaaccagaacgtactctctggggaaaattaaaaacaataaaggagaagatttacagatgttagacatacacggggtagagaagagctgggtagaagagatagacaaagaagcaaggaaaacaatggcaaccttgcttaaggaatcatcaggtaatatcccacaaaatcagaggccctcagcaccagacacacccataatcttattatgtgtaggtgccttaatattcactaaactagcatcaaccatagaagtgggactagagaccacagtcagaagggctaaccgtgtactaagtgatgcactcaagagataccctagaatggacataccaaagattgccagatccttctatgacttatttgaacaaaaagtgtatcacagaagtttgttcattgagtatggcaaagcattaggctcatcatctacaggcagcaaagcagaaagtctatttgttaatatattcatgcaagcttatggggccggtcaaacaatgctaaggtggggggtcattgccaggtcatccaacaatataatgttaggacatgtatccgtccaagctgagttaaaacaggtcacagaagtctatgacttggtgcgagaaatgggccctgaatctggacttctacatttaaggcaaagcccaaaagctggactgttatcactagccaactgtcccaactttgcaagtgttgttctcggaaatgcctcaggcttaggcataatcggtatgtatcgagggagagtaccaaacacagaattattttcagcagctgaaagttatgccaaaagtttgaaagaaagcaataaaataaatttctcttcattaggacttacagatgaagagaaagaggctgcagaacatttcttaaatgtgagtgacgacagtcaaaatgattatgagtaa

SEQ ID NO: 371 - DNA, 1185 bp, human metapneumo virus
atgtctcttcaagggattcacctgagtgatctatcatacaagcatgctatattaaaagagtctcagtatacaataaagagagatgtaggcacaacaaccgcagtgacaccctcatcattgcaacaagaaataacactattgtgtggagaaattctatatgctaagcatgctgattacaaatatgctgcagaaataggaatacaatatattagcacagctctaggatcagagagagtacagcagattctaagaaactcaggtagtgaagtccaagtggttttaaccagaacgtactccttggggaaagttaaaaacaacaaaggagaagatttacagatgttagacatacacggagtagagaaaagctgggtggaagagatagacaaagaagcaagaaaaacaatggcaactttgcttaaagaatcatcaggcaatattccacaaaatcagaggccttcagcaccagacacacccataatcttattatgtgtaggtgccttaatatttaccaaactagcatcaactatagaagtgggattagagaccacagtcagaagagctaaccgtgtactaagtgatgcactcaaaagataccctaggatggacataccaaaaatcgctagatctttctatgacttatttgaacaaaaagtgtattacagaagtttgttcattgagtatggcaaagcattaggctcatcctctacaggcagcaaagcagaaagtttattcgttaatatattcatgcaagcttacggtgctggtcaaacaatgctgaggtggggagtcattgccaggtcatctaacaatataatgttaggacatgtatctgttcaagctgagttaaaacaagtcacagaagtctatgacctggtgcgagaaatgggccctgaatctgggctcctacatttaaggcaaagcccaaaagctggactgttatcactagccaattgtcccaactttgctagtgttgttctcggcaatgcctcaggcttaggcataataggtatgtatcgcgggagagtgccaaacacagaactattttcagcagcagaaagctatgccaagagtttgaaagaaagcaataaaattaacttttcttcattaggactcacagatgaagaaaaagaggctgcagaacacttcctaaatgtgagtgacgacagtcaaaatgattatgagtaa

SEQ ID NO: 372 - DNA, 1185 bp, human metapneumo virus
atgtctcttcaagggattcacctaagtgatctatcatataaacatgctatattaaaagagtctcaatacacaataaaaagagatgtaggcaccacaactgcagtgacaccttcatcattacaacaagaaataacacttttgtgtggggaaatactttacactaaacacactgattacaaatatgctgctgagataggaatacaatatatttgcacagctctaggatcagaaagagtacaacagattttgagaaactcaggtagtgaagttcaggtggttctaaccaaaacatactccttagggaaaggcaaaaacagtaaaggggaagagctgcagatgttagatatacatggagtggaaaagagttggatagaagaaatagacaaagaggcaagaaagacaatggtaactttgcttaaggaatcatcaggtaacatcccacaaaaccagagaccttcagcaccagacacaccaataattttattatgtgtaggtgccctaatattcactaaactagcatcaacaatagaagttggattagagactacagttagaagagctaatagagtgctaagtgatgcactcaaaagatacccaaggatagatataccaaagattgctagatctttttatgaactatttgaacaaaaagtgtactacagaagtttattcattgagtacggaaaagctttaggctcatcttcaacaggaagcaaagcagaaagtttgtttgtaaatatatttatgcaagcttatggagctggccaaacactgctaaggtggggtgtcattgccagatcatccaacaacataatgctagggcatgtatctgtgcaatctgaattgaagcaagttacagaggtttatgacttggtgagagaaatgggtcctgaatctgggcttttacatctaagacaaagtccaaaggcagggctgttatcattggccaattgccccaattttgctagtgttgttcttggcaatgcttcaggtctaggcataatcggaatgtacagagggagagtaccaaacacagagctattttctgcagcagaaagttatgccagaagcttaaaagaaagcaataaaatcaacttctcttcgttagggcttacagatgaagaaaaagaagctgcagaacacttcttaaacatgagtggtgacaatcaaaatgattatgagtaa

SEQ ID NO: 373 - DNA, 1185 bp, human metapneumo virus
atgtctcttcaagggattcacctaagtgatctgtcatataaacatgctatattaaaagagtctcaatacacaataaaaagagatgtaggcaccacaactgcagtgacaccttcatcattgcagcaagagataacacttttgtgtggagagattctttacactaaacatactgattacaaatatgctgcagagatagggatacaatatatttgcacagctctaggatcagaaagagtacaacagattttaagaaattcaggtagtgaggttcaggtggttctaaccaagacatactctttagggaaaggtaaaaatagtaaaggggaagagttgcaaatgttagatatacatggagtggaaaagagttgggtagaagaaatagacaaagaggcaagaaaaacaatggtgactttgctaaaggaatcatcaggcaacatcccacaaaaccagaggccttcagcaccagacacaccaataattttattgtgtgtaggtgctttaatattcactaaactagcatcaacaatagaagttggactagagactacagttagaagggctaacagagtgttaagtgatgcgctcaaaagataccctagggtagatataccaaagattgctagatctttttatgaactatttgagcagaaagtgtattacaggagtctattcattgagtatgggaaagctttaggctcatcttcaacaggaagcaaagcagaaagtttgtttgtaaatatatttatgcaagcttatggagccggtcagacaatgctaaggtggggtgtcattgccagatcatctaacaacataatgctagggcatgtatctgtgcaagctgaattgaaacaagttacagaggtttatgatttggtaagagaaatgggtcctgaatctgggcttttacatctaagacaaagtccaaaggcaggactgttatcgttggctaattgccccaattttgctagtgttgttcttggtaatgcttcaggtctaggtataatcggaatgtacaggggaagagtgccaaacacagagctattttctgcagcagaaagttatgccagaagcttaaaagaaagcaacaaaatcaacttctcctcattagggctcacagacgaagaaaaagaagctgcagaacacttcttaaacatgagtgatgacaatcaagatgattatgagtaa

SEQ ID NO: 374 - protein, 294 aa, human metapneumo virus
MSFPEGKDILFMGNEAAKLAEAFQKSLRKPGHKRSQSIIGEKVNTVSETLELPTISRPAKPTIPSEPKLAWTDKGGATKTEIKQAIKVMDPIEEEESTEKKVLPSSDGKTPAEKKLKPSTNTKKKVSFTPNEPGKYTKLEKDALDLLSDNEEEDAESSILTFEERDTSSLSIEARLESIEEKLSMILGLLRTLNIATAGPTAARDGIRDAMIGVREELIADIIKEAKGKAAEMMEEEMSQRSKIGNGSVKLTEKAKELNKIVEDESTSGESEEEEEPKDTQDNSQEDDIYQLIM

SEQ ID NO: 375 - protein, 294 aa, human metapneumo virus
MSFPEGKDILFMGNEAAKLAEAFQKSLRKPNHKRSQSIIGEKVNTVSETLELPTISRPTKPTILSEPKLAWTDKGGAIKTEAKQTIKVMDPIEEEEFTEKRVLPSSDGKTPAEKKLKPSTNTKKKVSFTPNEPGKYTKLEKDALDLLSDNEEEDAESSILTFEERDTSSLSIEARLESIEEKLSMILGLLRTLNIATAGPTAARDGIRDAMIGIREELIADIIKEAKGKAAEMMEEEMNQRTKIGNGSVKLTEKAKELNKIVEDESTSGESEEEEEPKDTQENNQEDDIYQLIM

SEQ ID NO: 376 - protein, 294 aa, human metapneumo virus
MSFPEGKDILFMGNEAAKIAEAFQKSLKKSGHKRTQSIVGEKVNTISETLELPTISKPARSSTLLEPKLAWADNSGITKITEKPATKTTDPVEEEEFNEKKVLPSSDGKTPAEKKSKFSTSVKKKVSFTSNEPGKYTKLEKDALDLLSDNEEEDAESSILTFEEKDTSSLSIEARLESIEEKLSMILGLLRTLNIATAGPTAARDGIRDAMIGIREELIAEIIKEAKGKAAEMMEEEMNQRSKIGNGSVKLTEKAKELNKIVEDESTSGESEEEEEPKETQDNNQGEDIYQLIM

SEQ ID NO: 377 - protein, 294 aa, human metapneumo virus
MSFPEGKDILFMGNEAAKIAEAFQKSLKRSGHKRTQSIVGEKVNTISETLELPTISKPARSSTLLEPKLAWADSSGATKTTEKQTTKTTDPVEEEELNEKKVSPSSDGKTPAEKKSKSPTNVKKKVSFTSNEPGKYTKLEKDALDLLSDNEEEDAESSILTFEERDTSSLSIEARLESIEEKLSMILGLLRTLNIATAGPTAARDGIRDAMIGIREELIAEIIKEAKGKAAEMMEEEMNQRSKIGNGSVKLTEKAKELNKIVEDESTSGESEEEEEPKETQDNNQGEDIYQLIM

SEQ ID NO: 378 - DNA, 885 bp, human metapneumo virus
atgtcattccctgaaggaaaagatattcttttcatgggtaatgaagcagcaaaattagcagaagctttccagaaatcattaagaaaaccaggtcataaaagatctcaatctattataggagaaaaagtgaatactgtatcagaaacattggaattacctactatcagtagacctgcaaaaccaaccataccgtcagaaccaaagttagcatggacagataaaggtggggcaaccaaaactgaaataaagcaagcaatcaaagtcatggatcccattgaagaagaagagtctaccgagaagaaggtgctaccctccagtgatgggaaaacccctgcagaaaagaaactgaaaccatcaactaacaccaaaaagaaggtttcatttacaccaaatgaaccagggaaatatacaaagttggaaaaagatgctctagatttgctctcagataatgaagaagaagatgcagaatcttcaatcttaacctttgaagaaagagatacttcatcattaagcattgaggccagattggaatcaatagaggagaaattaagcatgatattagggctattaagaacactcaacattgctacagcaggacccacagcagcaagagatgggatcagagatgcaatgattggcgtaagagaggaattaatagcagacataataaaggaagctaaagggaaagcagcagaaatgatggaagaggaaatgagtcaacgatcaaaaataggaaatggtagtgtaaaattaacagaaaaagcaaaagagctcaacaaaattgttgaagatgaaagcacaagtggagaatccgaagaagaagaagaaccaaaagacacacaagacaatagtcaagaagatgacatttaccagttaattatgtag

SEQ ID NO: 379 - DNA, 885 bp, human metapneumo virus
atgtcattccctgaaggaaaagatattcttttcatgggtaatgaagcagcaaaattggcagaagcttttcaaaaatcattaagaaaacctaatcataaaagatctcaatctattataggagaaaaagtgaacactgtatctgaaacattggaattacctactatcagtagacctaccaaaccgaccatattgtcagagccgaagttagcatggacagacaaaggtggggcaatcaaaactgaagcaaagcaaacaatcaaagttatggatcctattgaagaagaagagtttactgagaaaagggtgctgccctccagtgatgggaaaactcctgcagaaaagaagttgaaaccatcaaccaacactaaaaagaaggtctcatttacaccaaatgaaccaggaaaatacacaaagttggagaaagatgctctagacttgctttcagacaatgaagaagaagatgcagaatcctcaatcttaaccttcgaagaaagagatacttcatcattaagcattgaagccagactagaatcgattgaggagaaattaagcatgatattagggctattaagaacactcaacattgctacagcaggacccacagcagcaagagatgggatcagagatgcaatgattggcataagggaggaactaatagcagacataataaaagaagccaagggaaaagcagcagaaatgatggaagaagaaatgaaccagcggacaaaaataggaaacggtagtgtaaaattaactgaaaaggcaaaggagctcaacaaaattgttgaagacgaaagcacaagtggtgaatccgaagaagaagaagaaccaaaagacacacaggaaaataatcaagaagatgacatttaccagttaattatgtag

SEQ ID NO: 380 - DNA, 885 bp, human metapneumo virus
atgtcattccctgaaggaaaggatattctgttcatgggtaatgaagcagcaaaaatagccgaagctttccagaaatcactgaaaaaatcaggtcacaagagaactcaatctattgtaggggaaaaagttaacactatatcagaaactctagaactacctaccatcagcaaacctgcacgatcatctacactgctggaaccaaaattggcatgggcagacaacagcggaatcaccaaaatcacagaaaaaccagcaaccaaaacaacagatcctgttgaagaagaggaattcaatgaaaagaaagtgttaccttccagtgatgggaagactcctgcagagaaaaaatcaaagttttcaaccagtgtaaaaaagaaagtttcctttacatcaaatgaaccagggaaatacaccaaactagagaaagatgccctagatttgctctcagacaatgaggaagaagacgcagaatcctcaatcctaacttttgaggagaaagatacatcatcactaagcattgaagctagactagaatctatagaagagaagttgagcatgatattaggactgcttcgtacacttaacattgcaacagcaggaccaacagctgcacgagatggaattagggatgcaatgattggtataagagaagagctaatagcagagataattaaggaagccaagggaaaagcagctgaaatgatggaagaagagatgaatcaaagatcaaaaataggaaatggcagtgtaaaactaaccgagaaggcaaaagagctcaacaaaattgttgaagacgagagcacaagcggtgaatcagaagaagaagaagaaccaaaagaaactcaggataacaatcaaggagaagatatttatcagttaatcatgtag

SEQ ID NO: 381 - DNA, 885 bp, human metapneumo virus
atgtcattccctgaaggaaaagatatcctgttcatgggtaatgaagcagcaaaaatagcagaagctttccagaaatcactaaaaagatcaggtcacaaaagaacccagtctattgtaggggaaaaagtaaacactatatcagaaactctagagctacctaccatcagcaaacctgcacgatcatctacactgctagagccaaaattggcatgggcagacagcagcggagccaccaaaaccacagaaaaacaaacaaccaaaacaacagatcctgttgaagaagaggaactcaatgaaaagaaggtatcaccttccagtgatgggaagactcctgcagagaaaaaatcaaaatctccaaccaatgtaaaaaagaaagtttccttcacatcaaatgaaccagggaaatatactaaactagaaaaagatgccctagatttgctctcagacaatgaggaagaagacgcagagtcctcaatcctaacctttgaagagagagacacatcatcactaagcattgaggctagactagaatcaatagaagagaagctaagcatgatattaggactgcttcgtacacttaacattgcaacagcaggaccaacggctgcaagggatggaatcagagatgcaatgattggtataagagaagaactaatagcagaaataataaaagaagcaaagggaaaagcagccgaaatgatggaagaggaaatgaatcaaaggtcaaaaataggtaatggcagtgtaaaactaaccgagaaggcaaaagaacttaataaaattgttgaagacgagagcacaagtggtgaatcagaagaagaagaagaaccaaaagaaactcaggataacaatcaaggagaagatatctaccagttaatcatgtag

SEQ ID NO: 382 - protein, 183 aa, human metapneumo virus
MITLDVIKSDGSSKTCTHLKKIIKDHSGKVLIVLKLILALLTFLTVTITINYIKVENNLQICQSKTESDKKDSSSNTTSVTTKTTLNHDITQYFKSLIQRYTNSAINSDTCWKINRNQCTNITTYKFLCFKSEDTKTNNCDKLTDLCRNKPKPAVGVYHIVECHCIYTVKWKCYHYPTDETQS

SEQ ID NO: 383 - protein, 179 aa, human metapneumo virus
MITLDVIKSDGSSKTCTHLKKIIKDHSGKVLIALKLILALLTFFTITITINYIKVENNLQICQSKTESDKEDSPSNTTSVTTKTTLDHDITQYFKRLIQRYTDSVINKDTCWKISRNQCTNITTYKFLCFKPEDSKINSCDRLTDLCRNKSKSAAEAYHTVECHCIYTIEWKCYHHPID

SEQ ID NO: 384 - protein, 177 aa, human metapneumo virus
MKTLDVIKSDGSSETCNQLKKIIKKHSGKVLIALKLILALLTFFTATITVNYIKVENNLQACQPKNESDKKVTKPNTTSTTIRPTPDPTVVHHLKRLIQRHTNSVTKDSDTCWRIHKNQRTNIKIYKFLCSGFTNSKGTDCEEPTALCDKKLKTIVEKHRKAECHCLHTTEWGCLHP

SEQ ID NO: 385 - protein, 177 aa, human metapneumo virus
MKTLDVIKSDGSSETCNQLKKIIKKHSGKLLIALKLILALLTFFTVTITVNYIKVENNLQACQLKNESDKKDTKLNTTSTTIRPIPDLNAVQYLKRLIQKHTNFVIKDRDTCWRIHTNQCTNIKIYKFLCFGFMNSTNTDCEELTVLCDKKSKTMTEKHRKAECHCLHTTEWWCYYL

SEQ ID NO: 386 - DNA, 552 bp, human metapneumo virus
atgataacattagatgtcattaaaagtgatgggtcttcaaaaacatgtactcacctcaaaaaaataattaaagaccactctggtaaagtgcttattgtacttaagttaatattagctttactaacatttctcacagtaacaatcaccatcaattatataaaagtggaaaacaatctgcaaatatgccagtcaaaaactgaatcagacaaaaaggactcatcatcaaataccacatcagtcacaaccaagactactctaaatcatgatatcacacagtattttaaaagtttgattcaaaggtatacaaactctgcaataaacagtgacacatgctggaaaataaacagaaatcaatgcacaaatataacaacatacaaatttttatgttttaaatctgaagacacaaaaaccaacaattgtgataaactgacagatttatgcagaaacaaaccaaaaccagcagttggagtgtatcacatagtagaatgccattgtatatacacagttaaatggaagtgctatcattacccaaccgatgaaacccaatcctaa

SEQ ID NO: 387 - DNA, 540 bp, human metapneumo virus
atgataacattagatgtcattaaaagtgatgggtcttcaaaaacatgtactcacctcaaaaaaataatcaaagaccattctggtaaagtgcttattgcacttaagttaatattagctttactaacatttttcacaataacaatcactataaattacataaaagtagaaaacaatctacaaatatgccagtcaaaaactgaatcagacaaagaagactcaccatcaaataccacatccgtcacaaccaagactactctagaccatgatataacacagtattttaaaagattaattcaaaggtatacagattctgtgataaacaaggacacatgctggaaaataagcagaaatcaatgcacaaatataacaacatataaatttttatgctttaaacctgaggactcaaaaatcaacagttgtgatagactgacagatctatgcagaaacaaatcaaaatcagcagctgaagcatatcatacagtagaatgccattgcatatacacaattgagtggaagtgctatcaccacccaatagattaa

SEQ ID NO: 388 - DNA, 534 bp, human metapneumo virus
atgaaaacattagatgtcataaaaagtgatggatcctcagaaacgtgtaatcaactcaaaaaaataataaaaaaacactcaggtaaagtgcttattgcactaaaactgatattggccttactgacatttttcacagcaacaatcactgtcaactatataaaagtagaaaacaatttgcaggcatgtcaaccaaaaaatgaatcagacaaaaaggtcacaaagccaaataccacatcaacaacaatcagacccacacccgatccaactgtagtacatcatttgaaaaggctgattcagagacacaccaactctgtcacaaaagacagcgatacttgttggagaatacacaagaatcaacgtacaaatataaaaatatacaagttcttatgctctgggttcacaaattcaaaaggtacagattgtgaggaaccaacagccctatgcgacaaaaagttaaaaaccatagtagaaaaacatagaaaagcagaatgtcactgtctacatacaaccgagtgggggtgccttcatccctaa

SEQ ID NO: 389 - DNA, 534 bp, human metapneumo virus
atgaaaacattagatgtcataaaaagtgatggatcctcagaaacatgtaatcaactcaaaaaaataataaaaaaacactcaggtaaattgcttattgcattaaaactgatattggccttattgacgtttttcacagtaacaattactgttaactatataaaagtagaaaacaatttgcaggcatgtcaattaaaaaatgaatcagacaaaaaggacacaaagctaaataccacatcaacaacaatcagacccattcctgatctaaatgcagtacagtacttgaaaaggctgattcagaaacacaccaactttgtcataaaagacagagatacctgttggagaatacacacgaatcaatgcacaaatataaaaatatataagttcttatgtttcgggtttatgaattcaacaaatacagactgtgaagaactaacagttttatgtgataaaaagtcaaaaaccatgacagaaaaacataggaaagcagagtgtcactgtctacatacaaccgagtggtggtgttattatctttaa

We claim:

1. An isolated negative-sense single stranded RNA virus MPV belonging to the sub-family Pneumovirinae of the family Paramyxoviridae and identifiable as phylogenetically corresponding to the genus *Metapnuemovirus*, wherein the virus is a mammalian *metapnuemovirus* of variant B1.

2. The isolated negative-sense single stranded RNA virus of claim 1, wherein the F protein of the isolated negative-sense single stranded RNA virus is at least 95% identical to the F protein of SEQ ID NO316.

3. An isolated negative-sense single stranded RNA *metapnuemovirus*, wherein the genome of the virus comprises the nucleotide sequence of SEQ ID NO:18.

4. The virus of claim 1, 2 or 3, wherein the virus is an attenuated virus.

5. The isolated negative-sense single stranded RNA virus of claim 1, wherein the virus is phylogenetically more closely related to a viral isolate NL/1/99 (SEQ ID NO: 18) than it is related to a viral isolate NL/1/94 (SEQ ID NO:21).

6. The isolated negative-sense single stranded RNA virus of claim 2, wherein the F protein of the isolated negative-sense single stranded RNA virus is at least 99% identical to the F protein of SEQ ID NO:316.

* * * * *

UNITED STATES PATENT AND TRADEMARK OFFICE
CERTIFICATE OF CORRECTION

| | |
|---|---|
| PATENT NO. | : 7,449,324 B2 |
| APPLICATION NO. | : 10/371099 |
| DATED | : November 11, 2008 |
| INVENTOR(S) | : Fouchier et al. |

Page 1 of 1

It is certified that error appears in the above-identified patent and that said Letters Patent is hereby corrected as shown below:

On the Title page,

[*] Notice:    Subject to any disclaimer, the term of this patent is extended or adjusted under 35 USC 154(b) by (505) days Delete the phrase "by 505 days" and insert -- by 1175 days --

Signed and Sealed this

Eleventh Day of May, 2010

David J. Kappos
*Director of the United States Patent and Trademark Office*